United States Patent
Kenny et al.

(10) Patent No.: US 11,633,436 B2
(45) Date of Patent: Apr. 25, 2023

(54) CHOLESTEROL REDUCING COMPOSITIONS AND METHODS OF USE THEREOF

(71) Applicants: THE BROAD INSTITUTE, INC., Cambridge, MA (US); THE GENERAL HOSPITAL CORPORATION, Boston, MA (US); PRESIDENT AND FELLOWS OF HARVARD COLLEGE, Cambridge, MA (US)

(72) Inventors: Douglas Kenny, Cambridge, MA (US); Hera Vlamakis, Cambridge, MA (US); Ramnik Xavier, Cambridge, MA (US); Emily Balskus, Cambridge, MA (US); Damian Plichta, Cambridge, MA (US)

(73) Assignees: The Broad Institute, Inc., Cambridge, MA (US); The General Hospital Corporation, Boston, MA (US); President and Fellows of Harvard College, Cambridge, MA (US)

( * ) Notice: Subject to any disclaimer, the term of this patent is extended or adjusted under 35 U.S.C. 154(b) by 283 days.

(21) Appl. No.: 17/026,109

(22) Filed: Sep. 18, 2020

(65) Prior Publication Data
US 2021/0128642 A1    May 6, 2021

Related U.S. Application Data

(60) Provisional application No. 63/013,493, filed on Apr. 21, 2020, provisional application No. 62/903,581, filed on Sep. 20, 2019.

(51) Int. Cl.
C12N 15/09        (2006.01)
A61K 35/741       (2015.01)
A61P 3/06         (2006.01)
A61K 31/575       (2006.01)
A61K 9/00         (2006.01)
C12N 15/70        (2006.01)
C12N 9/04         (2006.01)
C12Q 1/26         (2006.01)
C12Q 1/10         (2006.01)

(52) U.S. Cl.
CPC .......... A61K 35/741 (2013.01); A61K 9/0053 (2013.01); A61K 31/575 (2013.01); A61P 3/06 (2018.01); C12N 9/0006 (2013.01); C12N 15/70 (2013.01); C12Q 1/10 (2013.01); C12Q 1/26 (2013.01); C12Y 101/03006 (2013.01); G01N 2333/902 (2013.01); G01N 2800/044 (2013.01); G01N 2800/065 (2013.01); G01N 2800/50 (2013.01)

(58) Field of Classification Search
CPC .................................................... C12N 15/09
See application file for complete search history.

(56) References Cited

PUBLICATIONS

Kiatpapan et al., "Heterologous expression of a gene encoding cholesterol oxidase in probiotic strains of Lactobacillus plantarum and Propionibacterium freudenreichii under the control of native promoters," Journal of Bioscience and Bioengineering 92(5):459-465, 2001.*

* cited by examiner

Primary Examiner — Rosanne Kosson
(74) Attorney, Agent, or Firm — F. Brent Nix, Esq.; Johnson, Marcou, Isaacs & Nix, LLC

(57) ABSTRACT

Microbes expressing cholesterol oxidoreductase (COR) proteins, methods of engineering the microbes expressing COR proteins, compositions and methods of using the microbes are provided.

24 Claims, 39 Drawing Sheets

Specification includes a Sequence Listing.

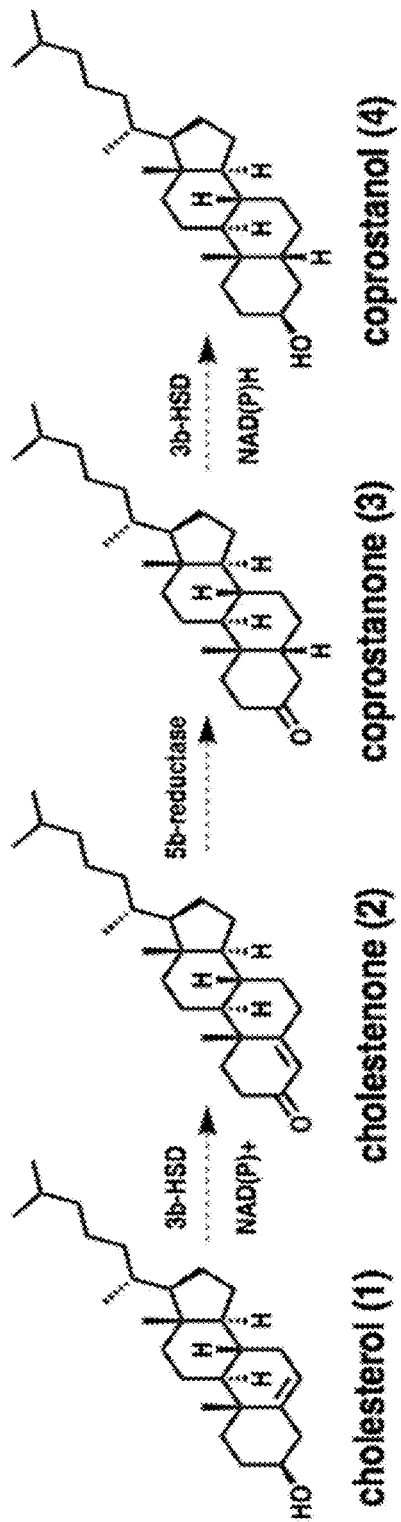
FIG. 1A
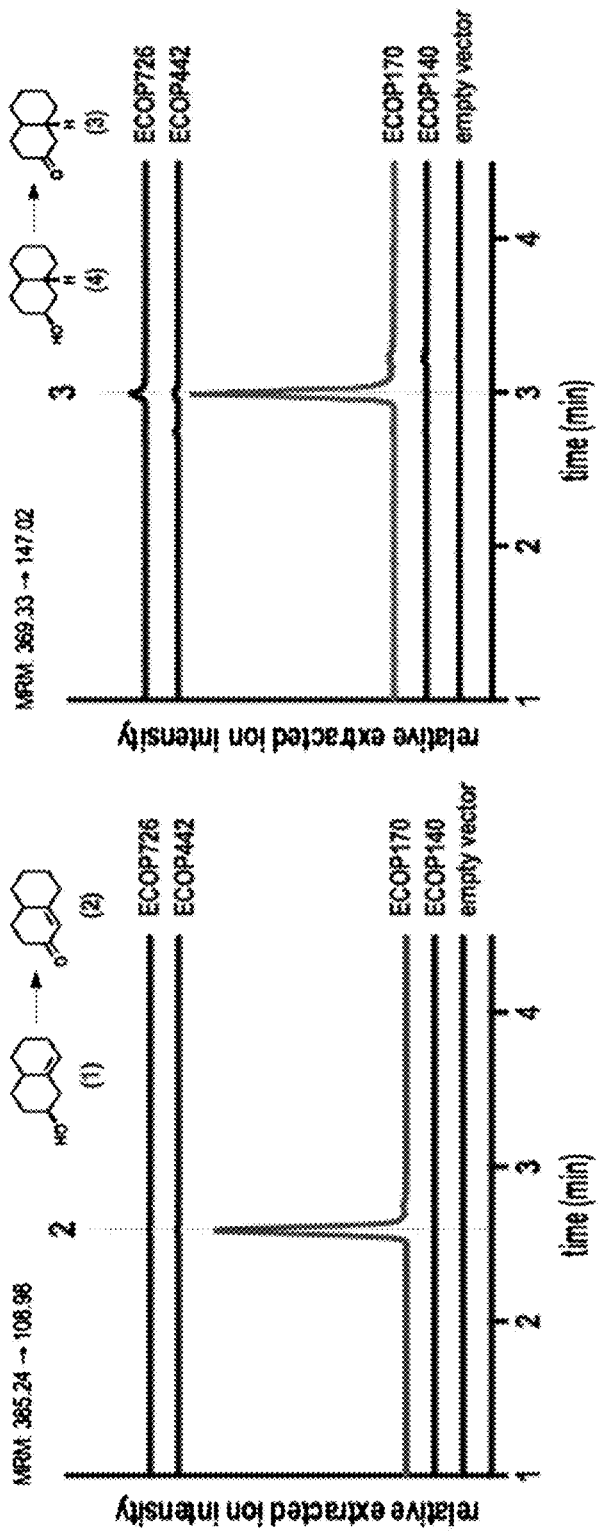
FIG. 1B
FIG. 1C

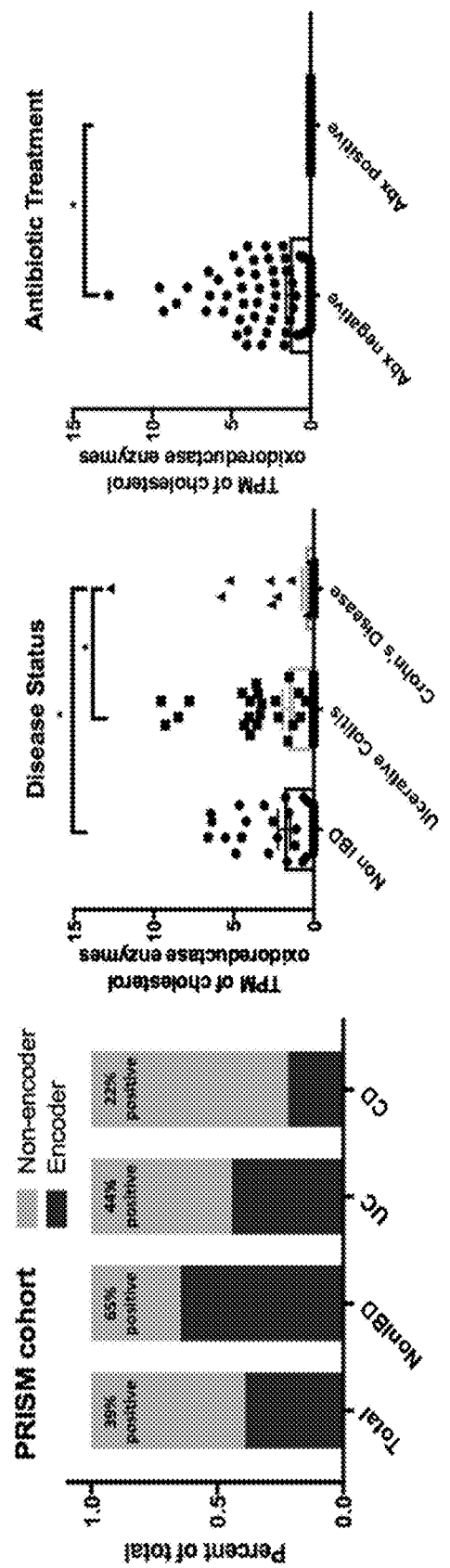

*E. coprostanoligenes* lysate experiment (Anaerobic)

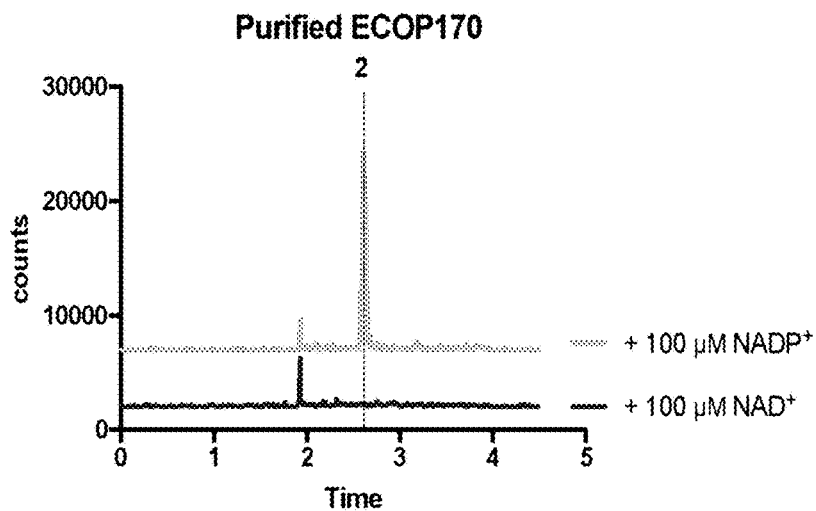
FIG. 11
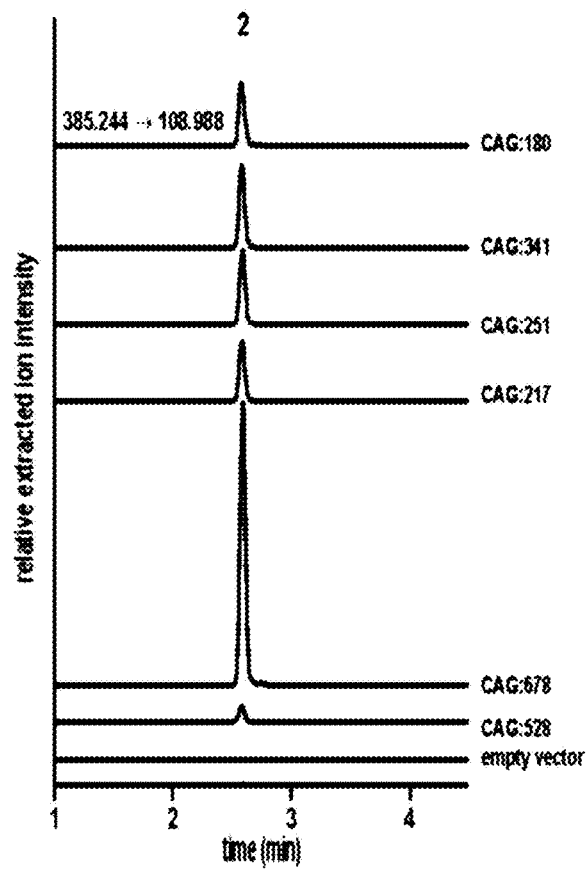 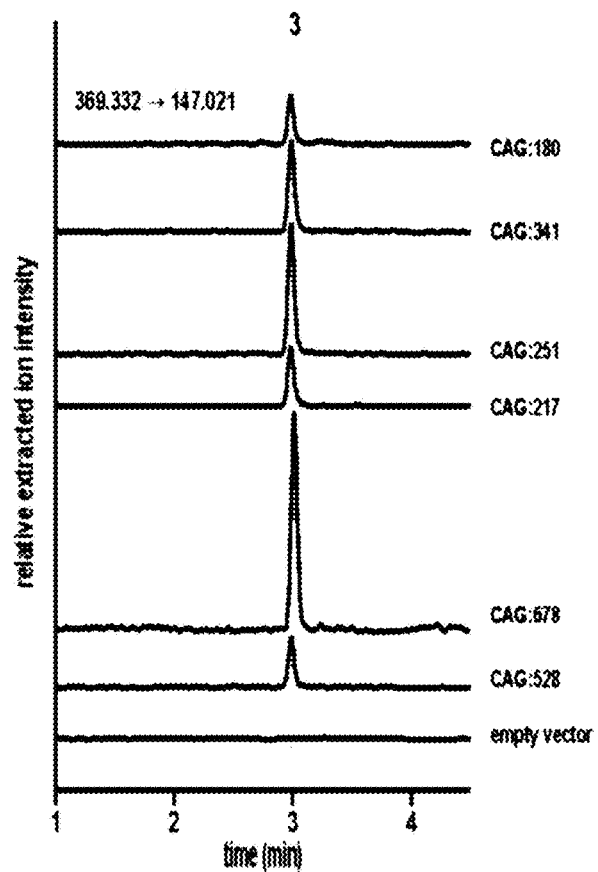
FIG. 12A          FIG. 12B

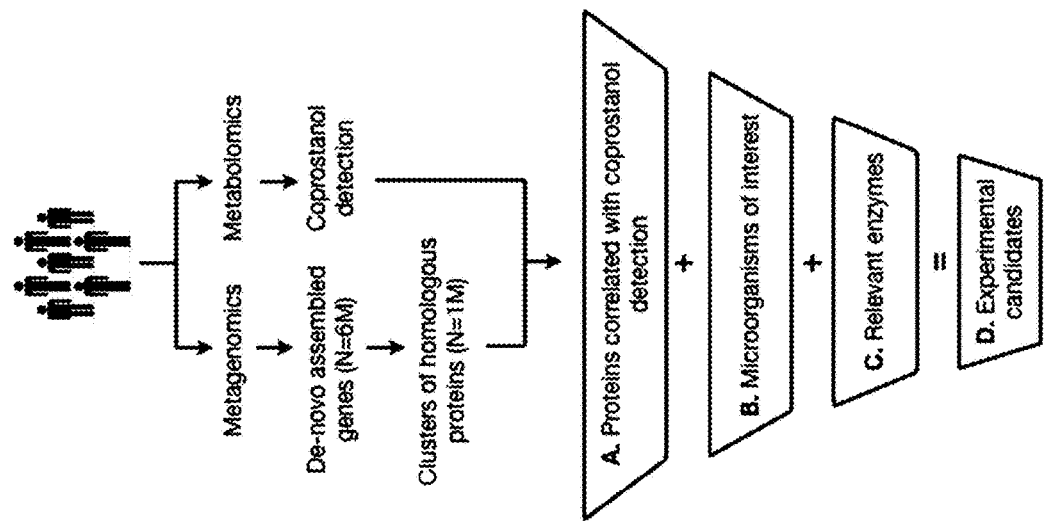
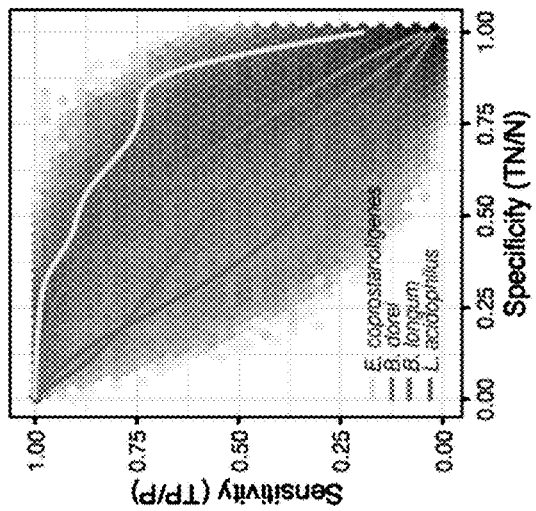
FIG. 17A
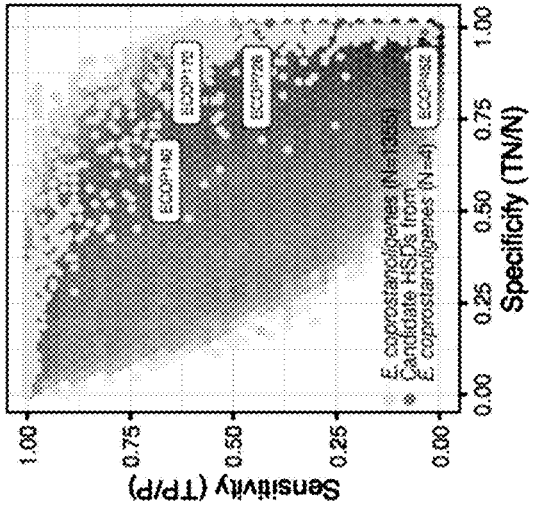
FIG. 17B
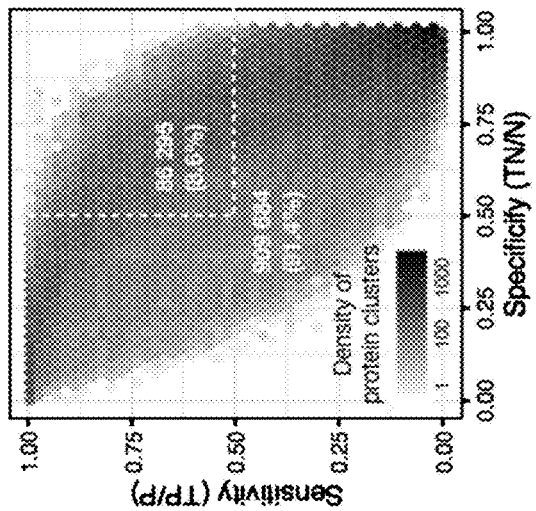
FIG. 17C
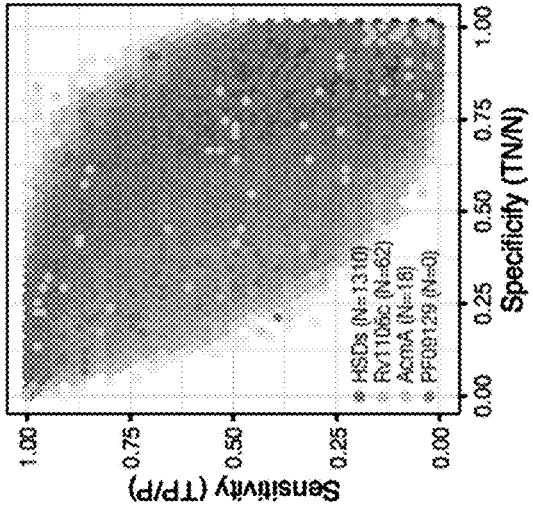
FIG. 17D
FIG. 17E

25 human-associated + 1 *E. coprostanoligenes* HSDs

| Tree | Sequence ID | 138 | | | 151 | | | | 155 |
|---|---|---|---|---|---|---|---|---|---|
| | G140183_k105_49941_12 | S | S | ... | Y | S | A | S | K |
| | G140899_k105_13945_6 | S | S | ... | Y | S | A | S | K |
| | ERR2017635_k103_44512_154 | S | S | ... | Y | S | A | S | K |
| | G140757_k105_15337_2 | S | S | ... | Y | S | A | S | K |
| | MSMA26BX_R_k105_8138_1 | S | S | ... | Y | S | A | S | K |
| | G48784_k105_68315_28 | S | S | ... | Y | S | A | S | K |
| | ECOP170 *E. coprostanoligenes* | S | S | ... | Y | S | A | S | K |
| | G88790_k105_50573_1 | S | S | ... | Y | S | A | S | K |
| | MSM5LLF6_R_k105_38794_2 | S | S | ... | Y | S | A | S | K |
| | G139953_k105_6325_8 | S | S | ... | Y | S | A | S | K |
| | G89005_k105_31711_1 | S | S | ... | Y | S | A | S | K |
| | G48791_k105_70309_15 | S | S | ... | Y | S | A | S | K |
| | ERR2017598_k103_131885_26 | S | S | ... | Y | S | S | S | K |
| | ERR2017655_k103_67238_7 | S | S | ... | Y | S | S | S | K |
| | ERR2017515_k79_109630_2 | S | S | ... | Y | S | S | S | K |
| | MSM9VZOK_R_k105_36925_1 | S | S | ... | Y | S | A | S | K |
| | G104929_k105_46920_10 | S | S | ... | Y | S | A | S | K |
| | G140022_k105_20980_2 | S | S | ... | Y | S | A | S | K |
| | HSM67VEO_R_k105_8042_1 | S | S | ... | Y | S | A | S | K |
| | G72720_k105_63499_8 | S | S | ... | Y | S | A | S | K |
| | G88988_k105_31485_1 | S | S | ... | Y | S | A | S | K |
| | G36365_k105_42273_10 | S | S | ... | Y | S | A | S | K |
| | G141014_k105_89139_1 | S | S | ... | Y | S | A | S | K |
| | MSM79H9K_R_k105_2566_3 | S | S | ... | Y | S | A | S | K |
| | G139962_k105_44646_2 | S | S | ... | Y | S | A | S | K |
| | MSMA26AX_R_k105_23254_2 | S | S | ... | Y | S | A | S | K |
| Mutants made in ECOP170: | | S138A | S139A | | Y151A | S152A | A153S | S154A | K155A |

FIG. 18D

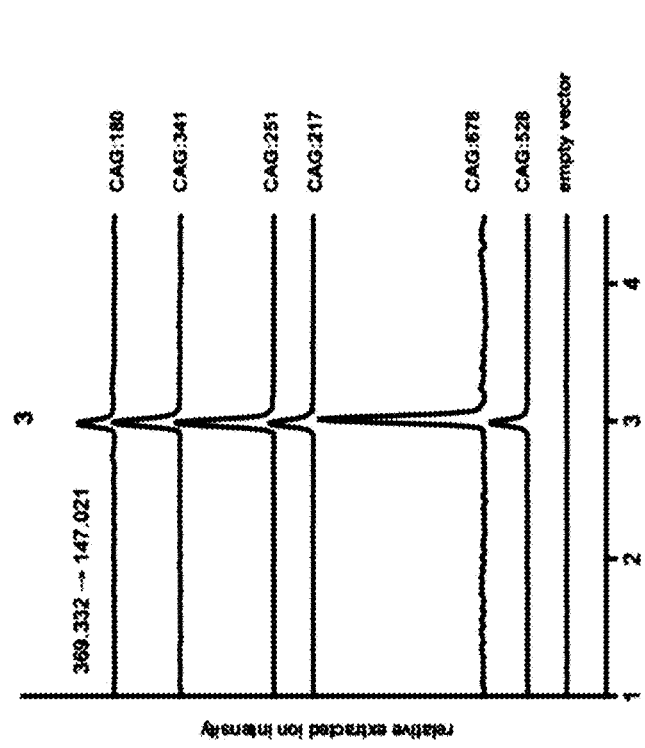
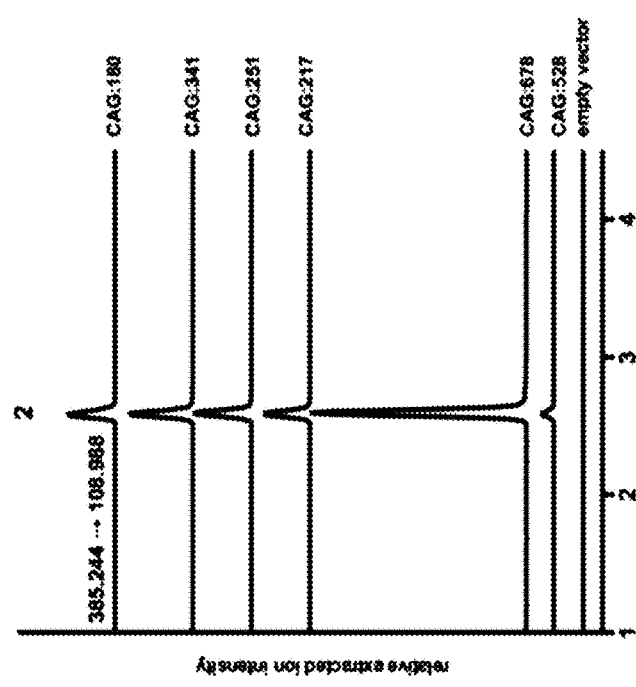
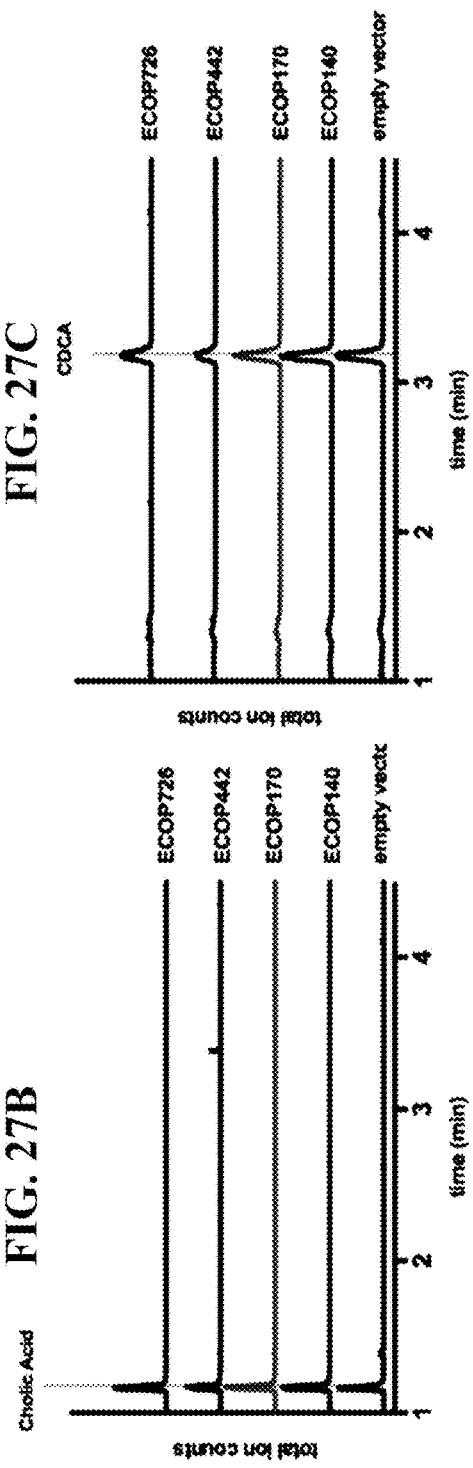
FIG. 27B
FIG. 27C
FIG. 27D

CHOLESTEROL REDUCING COMPOSITIONS AND METHODS OF USE THEREOF

CROSS-REFERENCE TO RELATED APPLICATIONS

This application claims the benefit of U.S. Provisional Application No. 62/903,581, filed Sep. 20, 2019 and U.S. Provisional Application No. 63/013,493, filed Apr. 21, 2020. The entire contents of the above-identified applications are hereby fully incorporated herein by reference.

STATEMENT REGARDING FEDERALLY SPONSORED RESEARCH

This invention was made with government support under Grant No.(s) DK043351, 5R01HL131015-04 and HL131015 awarded by the National Institutes of Health. The government has certain rights in the invention.

REFERENCE TO AN ELECTRONIC SEQUENCE LISTING

The contents of the electronic sequence listing ("BROD-4810US_ST25.txt"; Size is 4,334,096 bytes (4.3 MB on disk) and it was created on Sep. 18, 2020) is herein incorporated by reference in its entirety.

TECHNICAL FIELD

The subject matter disclosed herein is generally directed to microbes expressing cholesterol oxidoreductase (COR) proteins, compositions and uses thereof, in particular, for cholesterol and triglyceride reduction.

BACKGROUND

Cholesterol is a key biological molecule that functions as a structural component of all cellular membranes and is a precursor to steroid hormones, vitamin D and bile acids. Furthermore, hypercholesterolemia, or high cholesterol levels, is strongly associated with the progression of atherosclerosis and coronary heart disease. These conditions are linked to increased incidence of heart attack and stroke and are the cause of one-fourth of all deaths in industrialized countries.1 Two main sources of cholesterol are thought to influence levels of this metabolite in serum: host-derived cholesterol synthesized in the liver and exogenous cholesterol derived from dietary components of animal origin. The cholesterol that is synthesized in liver hepatocytes is transported to the gallbladder and is then secreted into the small intestine along with other bile salts. In the intestine, biliary cholesterol is mixed with dietary cholesterol, where it is eventually transported into enterocytes, packaged into chylomicrons, and secreted into the plasma.

A diverse number of microbes with expanded metabolic capabilities metabolize and chemically modify many of the dietary and host-derived molecules in the small intestine. Because both dietary and host-derived cholesterol passes through the small intestine, it has been proposed that the gut microbiota may influence cholesterol levels. Studies examining associations between gut microbial community composition and cholesterol levels have shown that taking into account the abundances of particular gut organisms can improve models to predict variance of cholesterol levels in serum.4,5 Other studies have found particular bacterial species, when administered as probiotics, can also have cholesterol-lowering effects on the host, although the precise mechanisms underlying this observation are currently unknown.

One proposed mechanism by which the gut microbiota may exert cholesterol-lowering effects is through the direct metabolism of intestinal cholesterol to coprostanol, a transformation known to occur in a subset of the human population since the 1930s. The intestinal gut microbiota can reduce the Δ5 double bond in cholesterol, changing the three-dimensional structure of the sterol core. Though biological consequences of this metabolic activity are largely unknown, one possible outcome is depletion of intestinal cholesterol, which could reduce intestinal cholesterol absorption by small intestinal enterocytes and consequently lower serum cholesterol levels. Notably, reducing cholesterol transport in the intestine is a clinically validated strategy for lowering cholesterol levels as demonstrated by ezetimibe, an FDA-approved small molecule inhibitor of the intestinal cholesterol transporter.

Over the past 90 years, scientists have attempted to assess whether coprostanol formation by gut microbes influences cholesterol homeostasis in humans. However, due to a lack of fecal metabolomics datasets and a limited understanding of the gut microbes, genes, and enzymes responsible for cholesterol metabolism, this connection has remained elusive.

Citation or identification of any document in this application is not an admission that such a document is available as prior art to the present invention.

SUMMARY

In certain example embodiments, non-naturally occurring microbes engineered to express one or more cholesterol oxidoreductase (COR) proteins or a homolog thereof. It will be appreciated that COR proteins and the genes that encode them are also referred herein and in the art with IsmA (Intestinal Sterol Metabolism) proteins and genes. The two nomenclatures are used interchangeably herein. In particular embodiments, the one or more COR homologs originate from phylum Firmicutes. The one or more COR homologs may also originate from or be in the direct neighborhood or marker species of Cluster IV or cluster XIVa *Clostridium* group. In embodiments, the one or more COR homologs originate from *Eubacterium*. In embodiments, the one or more COR homologs originate from *Eubacterium coprostanoligenes*, in one aspect, *Eubacterium coprostanoligenes* HL (ATCC 51222). In embodiments, the one or more COR homologs are derived from the human gut. In embodiments, the one or more human CORs are selected from one or more of sequences in Table 8. In embodiments, the microbe comprises a COR having at least 60% amino acid identity with ECOP170. The COR can be selected from one or more of the sequences in Table 1, selected from the group consisting of ECOP170, CAG:180, CAG:251, CAG:341, CAG:217, CAG:528, and CAG678, or be selected from one or more polypeptides having 60 to 100 percent amino acid identity with any one or more of the sequences provided in Table 1. In some embodiments, the COR can be selected from one or more polypeptides having about 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100 percent amino acid identity to one or more of the sequences in Table 1.

In embodiments, the microbe is further engineered to express an enzyme capable of converting cholestenone to coprostanone. The microbe may be further engineered to express a cholesterol transporter. In some embodiments, the microbe is an engineered variant of a microbe within the phyla of Firmicutes, Bacteroidetes, Actinobacteria, Bacteroidetes, Proteobacteria, Fusobacteria, Verrucomicrobia, Euryarchaeota, or Ascomycota. In some embodiments, the microbe is an engineered variant of a microbe within the genus *Corynebacterium, Bifidobacterium, Atopobium, Faecalibacterium, Clostridium, Roseburia, Ruminococcus, Dialister, Lactobacillus, Enterococcus, Staphylococcus, Streptococcus, Sphingobacterium, Bacteroides, Tannerella, Parabacteroides, Alistipes, Prevotella, Escherichia, Shigella, Desulfovibrio, Bilophila, Helicobacter, Fusobacterium, Pediococcus, Bacillus, Leuconostoc, Akkermansia, Methanobrevibacter, Propionibacterium, Coriobacteriaceae, Actinobacteria, Rikenellaceae, Lachnospiraceae, Firmicutes, Peptostreptococcaceae, Veillonella, Oscillospira, Dialister, Slackia, Eggerthella, Gordonibacter, Geobacter Alkaliphilus, Catenibacterium, Holdemania, Marvinbryantia, Symbiobacterium, Roseburia, Erysipelotrichaceae, Butyricicoccus, Sporobacter, Blautia, Dorea, Succinivibrio, Barnesiella, Biolophila, Eubacterium*, or *Saccharomyces*. In embodiments, the microbe is an engineered variant of a *Lactobacillus, Bifidobacterium, Saccharomyces, Enterococcus, Streptococcus, Pediococcus, Leuconostoc, Bacillus*, or *Escherichia coli*. A composition comprising any one of the microbes described herein is also disclosed. In embodiments, the composition is formulated for oral delivery.

Probiotic compositions comprising one or more microbes encoding one or more CORs are also provided. In embodiments, the probiotic may comprise one or more microbes from the phylum Firmicutes, or one or more microbes may also originate from or be in the direct neighborhood or marker species of Cluster IV or cluster XIVa *Clostridium* group. In embodiments, the probiotic composition may comprise one or more microbes from *Eubacterium*, preferably, *Eubacterium coprostanoligenes*, more preferably, *Eubacterium coprostanoligenes* HL (ATCC 51222). In embodiments, the one or more microbes are selected from the Metagenomic Species (MSP) MSP_0701, MSP_0759, MSP_0654, MSP_0205, MSP_0421, MSP_0764, MSP_0238, MSP_0522, MSP_0672, MSP_0602, MSP_0645, MSP_0476, MSP_0640, MSP_0676, MSP_0638, MSP_0562, MSP_0196, MSP_0741, MSP_0910, MSP0832, ObregonTitoAJ_2015_NO16_bin.9, UMGS233, UMGS598, UMGS135, GeversD_2014_SKBSTL024_bin.4, UMGS98, LeChatelierE_2013_MH0448 bin.22, SmitsSA_2017_TZ_65172_bin.2, XieH_2016_YSZC12003_36049_bin.90, LoombaR_2017_SID5447_cka_bin.41, VincentC_2016_MM029.3_bin.33, UMGS234, UMGS1867, ZellerG_2014_CCIS11015875ST-4-0_bin.2, or permissible combinations thereof. The probiotic compositions may also include engineered microbes as disclosed herein. The probiotic composition can be formulated for oral, optionally a powder, bolus gel, capsule, liquid, or foodstuff. In some embodiments, the probiotic may comprise one or more prebiotics.

A method of reducing cholesterol uptake in a subject is also provided, comprising delivering coprostanol, cholestenone, or coprostanone in an effective amount to lower serum cholesterol in the subject. In embodiments, the coprostanol, cholestenone, or coprostanone is provided in a water dispersible solid form.

A method of screening subjects for increased risk of high cholesterol or an Inflammatory Bowel Disease is provided comprising detecting the presence in of one or more COR encoding microbes in the gut of a subject. In one aspect, the detecting comprises culturing one or more COR encoding microbes or detecting one or more microbial COR genes or proteins in the fecal sample of the subject.

Methods of reducing serum total cholesterol and/or triglycerides in a subject comprising administering an engineered microbe as disclosed herein, a probiotic composition of the disclosure, or coprostanol, cholestenone, or coprostanone to a subject in need thereof. In an aspect, the subject has hypercholesterolemia.

These and other aspects, objects, features, and advantages of the example embodiments will become apparent to those having ordinary skill in the art upon consideration of the following detailed description of example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 1A-1E Uncharacterized 3β-HSDs from *E. coprostanoligenes* and phylogenetically related human-associated bacteria can oxidize cholesterol to cholestenone. FIG. 1A. The proposed pathway for coprostanol (4) formation in *Eubacterium coprostanoligenes* involves the intermediates cholestenone (2) and coprostanone (3). FIG. 1B. A 3β-hydroxysteroid dehydrogenase enzyme from *E. coprostanoligenes*, ECOP170, converts cholesterol (1) to cholestenone (2) and FIG. 1C. converts coprostanol (4) to coprostanone (3) in the presence of 100 µM of NAD$^+$ and 100 µM NADP$^+$. FIG. 1D. Blastp hits of ECOP170 in the NCBI database with at least 40% amino acid identity and 95% query coverage. 10 proteins with higher homology (>60% aa identity) to ECOP170 (purple circle) are from uncultured organisms and are deposited into the database as co-abundant gene groups (CAGs). FIG. 1E. ECOP170 homologues from gut bacteria expressed in *E. coli* convert cholesterol and coprostanol (gray squares) to their corresponding ketones (2 and 3 respectively) but were not able to convert primary bile acids to the corresponding keto bile acids (white squares). We considered the detection of any of the desired product in an assay conditions as metabolism.

FIG. 2A-2E—Prevalence of cholesterol oxidoreductases in human microbiomes across the different cohorts. FIG. 2A. Proportion of microbiome samples within each respective cohort that encodes one of the 25 COR homologs. FIG. 2B. Abundance of COR homologs vary across populations, with CORs from CAG:251, CAG:341, CAG:217 and CAG:180 being the most abundant homologs across all of the populations. Dotted lines show homologs that have been shown to metabolize cholesterol in vitro. FIG. 2C. Percentages of samples containing one of the 25 cholesterol homologs after stratification of the PRISM cohort by disease state. FIG. 2D. Levels of cholesterol oxidoreductase present in the microbiome when stratified by disease state (Total, n=155; NonIBD, n=34; UC, n=53; CD, n=68; nonIBD vs CD p=0.0101; UC vs CD p=0.0202). P values were determined by one-way ANOVA followed by Tukey's multiple comparisons test. FIG. 2E. Levels of cholesterol oxidoreductase present in the microbiome when stratified by antibiotic usage (Total, n=152; positive, n=134; negative, n=18; p=0.0182). P values were determined by two-tailed t test. Each point represents an independent sample with the center bar representing the mean and error bars representing s.e.m. (PRISM: cholesterol oxidoreductase negative samples n=96, positive samples n=60).

FIG. 4A. The presence of a cholesterol oxidoreductase homolog in the gut microbiome is highly correlated to the presence of fecal coprostanol (detected). Odds ratios for PRISM and HMP2 cohorts are 14.37 (95% CI: 5.41, 44.02) and 40.87 (95% CI: 18.02, 92.72) respectively. FIG. 4B. Stool samples from patients with cholesterol oxidoreductase in their microbiomes have lower stool cholesterol (1), and higher cholestenone (2) and coprostanol (4) as determined by untargeted fecal metabolomics. Each point represents an independent sample with the center bar representing the mean and error bars representing s.e.m. (PRISM: cholesterol oxidoreductase negative samples n=96, positive samples n=60, HMP2: cholesterol oxidoreductase negative samples n=310, positive samples n=161). Analysis was performed using linear (cholesterol and cholestenone) and logistic (coprostanol) regressions for PRISM and mixed effect linear (cholesterol and cholestenone) and logistic (coprostanol) models to account for repeated measures in HMP2, including the following as covariates in all models: age, gender, antibiotic usage (yes/no) and disease status (nonIBD, CD or UC). See methods for details. FIG. 4C. Ex vivo fecal conversion of cholesterol to coprostanol by stool samples. Coprostanol formation occurred in 5 of the 8 stool samples cultured in basal cholesterol medium, with 4 of these 5 containing at least one of the 25 cholesterol oxidoreductases identified at day 3. The one culture without a detectable cholesterol oxidoreductase generated coprostanol sluggishly, with metabolism only evident at day 6, and it is possible that cor+ bacteria were below the limit of detection at day 3.

FIG. 8A. *E. coprostanoligenes* doesn't assemble in human gut microbiomes. FIG. 8B. The four samples in which we detected a homolog to *E. coprostanoligenes*'s COR gene were mapped to the *E. coprostanoligenes*-augmented gene catalogue and in three of them we detected >80% of *E. coprostanoligenes* genes. FIG. 8C. Venn diagram for detected *E. coprostanoligenes* genes. FIG. 8D. Venn diagram for non-detected *E. coprostanoligenes* genes.

FIG. 11 In vitro activity assay of purified N-terminal His-tagged ECOP170 expressed in BL21 *E. coli*. Activity assay with ECOP170 (1.5 μM) in HEPES (pH=7.5, 50 mM, 300 mM NaCl) with 100 μM cholesterol and either 100 μM of $NADP^+$ (red) or 100 μM of $NAD^+$ (blue). EICs of 2 (rt 2.60, 385.244→108.988) are shown for both conditions.

FIG. 12A-12B CORs from human-associated gut microbes accept cholesterol and coprostanol but not primary bile acids. Activity assay with *E. coli* lysates (PBS, pH=7.4) expressing one of the cholesterol oxidoreductase enzymes from human-associated microbes with FIG. 12A. 100 μM cholesterol or FIG. 12B. 100 μM of coprostanol with 100 μM each of NAD+ and NADP+. EIC for the products of both reactions are shown.

FIG. 13A. 1,854 proteins with the highest amino acid percent identity to ECOP170 were identified. A histogram of the genes with an e-value of less than 1E-50 (33 genes) was made. The percent AA identity bins clearly show a gap in sequences between greater than 60% and less than 45% AA identity with ECOP170. The cutoff for putative cholesterol oxidoreductases was therefore set at 60% AA identity. The percent AA identity bins that contain a characterized cholesterol oxidoreductase protein are identified by the black border and diagonal pattern. FIG. 13B. Percent AA identity matrix between all 25 cholesterol oxidoreductase genes found within the combined microbiome assembly. FIG. 13C. A protein sequence similarity network (SSN) was constructed using the 1,854 proteins with greater than 20% AA identity to ECOP170 from the combined assembly. Nodes represent proteins with 100% sequence identity. The SSN is displayed with a percent AA identity threshold of 60%. The 25 cholesterol oxidoreductase proteins are circled and shown in light blue. All protein sequences used to generate this SSN are presented in Table S6.

FIG. 14A. Levels of cholesterol oxidoreductase present in the microbiome when stratified by disease state (Total, n=471; Non-IBD, n=123; UC, n=123; CD, n=225; nonIBD vs CD p=0.0566; UC vs CD p=0.0056). P values were determined by one-way ANOVA followed by Tukey's multiple comparisons test. FIG. 14B. Levels of cholesterol oxidoreductase present in the microbiome when stratified by antibiotic usage (Total, n=471; positive, n=429; negative, n=42; p=0.0684). P values were determined by two-tailed t test. Each point represents an independent sample with the center bar representing the mean and error bars representing s.e.m.

FIG. 17A-17E Integrative analysis of metagenomes, metabolomes, isolate genomes and enzymatic functions reveal candidate bacterial genes involved in cholesterol metabolism in the human gut microbiome. Human microbiome genes from a de-novo assembled gene catalogue, after additional clustering step into groups of homologous proteins (at least 50% AA identity), were correlated with coprostanol detection in paired metagenomic-metabolomic samples and further prioritized by incorporating information from relevant microorganisms and enzymes. (FIG. 17A) Scores of specificity and sensitivity in relation to presence of coprostanol were calculated for each cluster of homologous proteins and their density is represented through hexagonal bin plot; 8.6% of protein clusters are found with greater than 50% specificity and sensitivity to coprostanol detection. (FIG. 17B) Proteins encoded by gut microbes of interest (implicated in coprostanol formation in literature) were used to query the clusters of homologous proteins. Clusters containing proteins with >50% AA identity to proteins found within a specified organism were used to generate a smoothed trend line (see FIG. 24 for the location of species matched clusters). According to the location of these trend lines, *E. coprostanoligenes* matching clusters are more specifically associated with coprostanol formation than other microbes. (FIG. 17C) Clusters of homologous proteins were queried with characterized enzymes known to either catalyze the oxidation of cholesterol to cholestenone: cholesterol oxidases (PF09129), AcmA from *S. denitrificans* and Rv1106c from *M. tuberculosis*, or enzymes that can perform very similar chemical transformations (hydroxysteroid dehydrogenases, HSDs, from gut commensals). USEARCH ublast (Edgar, 2010) analysis was performed with inclusive cutoffs (>25% AA identity and 50% coverage). (FIG. 17D) Combining the evidence from FIG. 17A-17C, 4 putative HSDs in *E. coprostanoligenes* were identified, 3 of which (ECOP170, ECOP726, ECOP442) had high specificity with regards to the presence of coprostanol (>0.9), albeit with greatly varying sensitivity. All four enzymes were chosen for further biochemical validation. (FIG. 17A-D) Dataset 1 analysis, see FIG. 23A-D for dataset 2 analysis. FIG. 17E Overview of integrative analysis of metagenomes, metabolomes, isolate genomes and enzymatic functions.

FIG. 18A-18D Uncharacterized 3β-hydroxysteroid dehydrogenase (3β-HSD) enzymes from *E. coprostanoligenes* and phylogenetically related human-associated bacteria oxidize cholesterol to cholestenone. (FIG. 18A) A 3β-hydroxysteroid dehydrogenase enzyme from *E. coprostanoligenes*, ECOP170, converts cholesterol (1) to cholestenone (2) and (FIG. 18B) converts coprostanol (4) to coprostanone (3) in the presence of a mixture of 100 μM of NAD+ and 100 μM NADP+. (FIG. 18C) ECOP170 homologs from gut bacteria heterologously expressed in *E. coli* convert the 3β-OH groups (blue) of cholesterol and coprostanol (gray squares) to the corresponding ketones (2 and 3 respectively) but were not able to convert primary bile acids, which have 3α-OH groups (red), to the corresponding keto bile acids (white squares). The detection of any of the desired products after overnight incubation in an assay condition to be metabolism was considered. (FIG. 18D) A multiple sequence alignment of the 25 human-associated cholesterol oxidoreductase homologs and ECOP170 centered on the conserved active site residues S138, Y151 and K155. Mutation of any of these residues to alanine in ECOP170 completely abolishes activity (red) while proteins with mutations in neighboring residues retain activity (green). Cholesterol oxidoreductases highlighted in blue are confirmed biochemically to oxidize cholesterol.

(FIG. 19A) 20 different metagenomics species (MSPs) containing a cholesterol oxidoreductase gene could be identified in human gut microbiome datasets. Phylogenetic tree was generated using PhyloPhlAn (Segata et al., 2013) and includes all COR-encoding MSPs as well as species in the direct neighborhood or marker species for *Clostridium* Cluster IV and Cluster XIVa. (FIG. 19B) Ex vivo conversion of cholesterol to coprostanol by human fecal samples. Coprostanol formation occurred in 4 of the 8 samples cultured in basal cholesterol medium, with all 4 metabolizing samples containing at least one of the COR-encoding species identified at day 3. (FIG. 19C) Proportion of microbiome samples within each respective cohort that contains at least one COR-encoding species. Prevalence of COR-encoding species varies across populations, with COR-encoding species msp_0205, msp_0421, msp_0238, and msp_0196 being the most abundant across all of the populations examined. Dotted lines show species whose cholesterol oxidoreductase homologs have been shown to metabolize cholesterol in vitro. (FIG. 19D) Relative abundance levels of COR-encoding species present in the gut microbiome when stratified by disease state (HMP2: Total, n=1,581; Non-IBD, n=411, Avg rel. ab.=1.047; UC, n=437, Avg rel. ab.=0.8613; CD, n=733, Avg rel. ab.=0.4864; non-IBD vs UC p=0.72; non-IBD vs CD p=0.009; UC vs CD p=0.009; PRISM: Total, n=154; Non-IBD, n=34, Avg rel. ab.=1.51; UC, n=52, Avg rel. ab.=1.437; CD, n=68, Avg rel. ab.=0.525; non-IBD vs UC p=0.14; non-IBD vs CD p=1.33e-6; UC vs CD p=6.30e-4). P values were determined by a Wald test for PRISM (a linear model) and a Satterthwaite's method for HMP2 (a mixed linear model with random effect for subjects) and corrected for multiple comparisons with Benjamini-Hochberg method. The center bar represents the mean and error bars representing 95% confidence interval.

(FIG. 20A) Two independent human cohorts with paired fecal metagenomics and metabolomics were used to investigate the association between COR-encoding species and coprostanol formation. The presence of COR-encoding bacteria in the gut microbiome is highly correlated to the presence of fecal coprostanol (detected). Odds ratios for PRISM and HMP2 cohorts are 14.37 (95% CI: 5.41; 44.02) and 40.87 (95% CI: 18.02; 92.72), respectively. (FIG. 20B) Stool samples from patients with cor+ species in their microbiomes have lower stool cholesterol (1), and higher cholestenone (2) and coprostanol (4) as determined by untargeted fecal metabolomics. Each point represents an independent sample with the center bar representing the mean and error bars representing s.e.m. (PRISM: cor+ species negative samples n=99, positive samples n=55, HMP2: cor+ species negative samples n=302, positive samples n=169). Analysis was performed using linear (cholesterol and cholestenone) and logistic (coprostanol) regressions for PRISM and mixed effect linear (cholesterol and cholestenone) and logistic (coprostanol) models to account for repeated measures in HMP2, including the following as covariates in all models: age, gender, antibiotic usage (yes/no) and disease status (non-IBD, CD or UC). See methods for details. (FIG. 20C) Molar ratios of cholesterol (gray), cholestenone (dark blue) and coprostanol (light blue) are shown for 11 coprostanol positive stool samples from the PRISM cohort as measured by targeted metabolomics. Across the samples, molar ratios for coprostanol vary from 0.956 in sample 8982 to 0.074 in sample 8573. Molar ratios were calculated by taking the concentration for each metabolite of interest and dividing by the sum of the concentrations for each of the 3 metabolites measured within a sample. Concentrations of each of the metabolites in a fecal slurry were determined by a standard curve with reference standards.

FIG. 27A-27D CORs from human-associated gut microbes metabolize cholesterol and coprostanol but not primary bile acids.

Figures 1D, 1E:
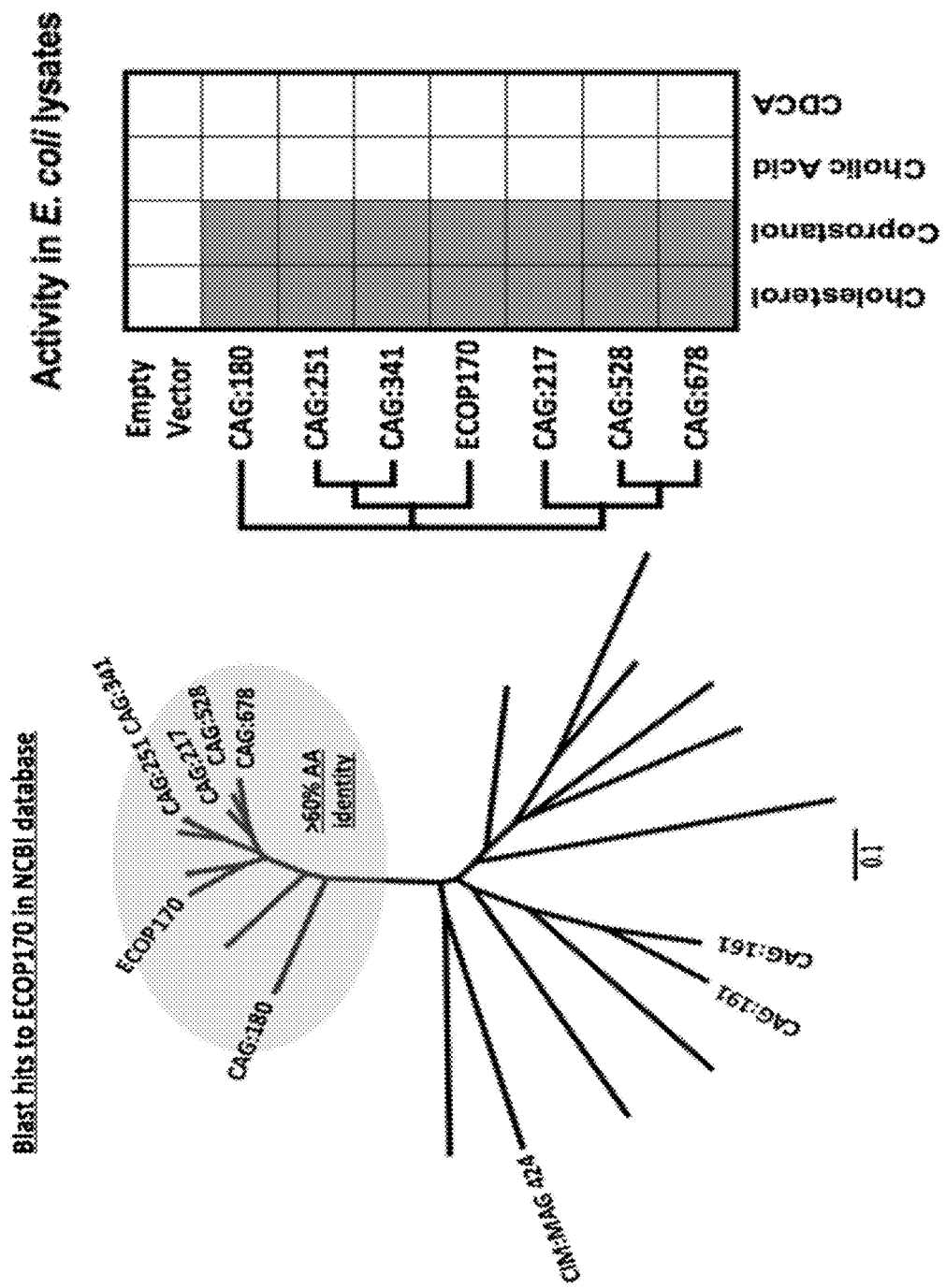

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, 2$^{nd}$ edition (1989) (Sambrook, Fritsch, and Maniatis); Molecular Cloning: A Laboratory Manual, 4$^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2$^{nd}$ edition 2013 (E. A. Greenfield ed.); Animal Cell Culture (1987) (R. I. Freshney, ed.); Benjamin Lewin, Genes IX, published by Jones and Bartlett, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, 2$^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Any compounds, compositions, or methods provided herein can be combined with one or more of any of the other compositions and methods provided herein.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

By "decreases" is meant a negative alteration. Such alterations are by 5%, 10%, 25%, 50%, 75%, 85%, 90% or even by 100% of a reference value.

By "increases" is meant a positive alteration. Such alterations are by 5%, 10%, 25%, 50%, 75%, 85%, 90% or even by 100% of a reference value.

By "effective amount" is meant the amount of an agent required to ameliorate the symptoms of a condition, disease or disorder relative to an untreated subject or organism. The effective amount of active agent(s) used to practice the present invention varies depending upon the manner of administration, the age, body weight, and general health of the subject.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

Embodiments disclosed herein provide a novel group of cholesterol oxidoreductase (COR) enzymes, also referred to herein as an IsmA protein, involved in the metabolism of cholesterol to cholestenone, an on-pathway intermediate to the final product coprostanol. Applicants have detected these enzymes as prevalent in geographically diverse gut microbiota and encoded by a clade of uncultured microorganisms. As described herein, individuals with coprostanol-forming microbes have significantly lower levels of fecal cholesterol and lower levels of serum total cholesterol and triglycerides.

Thus, it is believed the metabolism of cholesterol by microorganisms capable of metabolizing cholesterol may play an important role in modulating both intestinal and serum cholesterol levels, directly impacting human health.

As described herein, the discovery of a widespread family of cholesterol oxidoreductase (COR) enzymes from a clade of uncultured gut bacteria provide both a pathway that can be targeted for screening of compounds that can block the uptake of cholesterol and/or reduce serum total cholesterol and/or triglycerides. The presence of the cor genes in a microbiome predicts coprostanol presence in stool and can be used as a biomarker for microbial coprostanol formation in the intestine, removing the need for fecal metabolomics measurements. By expanding analysis to datasets with paired stool metagenomics and serum lipid measurements, Applicants have shown that the presence of COR enzymes is significantly and positively associated with decreased total cholesterol and triglyceride levels in serum, linking the presence of this microbial metabolism with changes in serum lipid levels. Hence, methods of reducing serum levels of total cholesterol and triglycerides are provided, and can include administration of coprostanol and other substrates for the COR enzymes, and/or microbes expressing a COR protein. In an embodiment, the methods comprise delivery of both coprostanol and other substrates, and one or more microbes expressing a COR protein.

Engineered Microbes

Provided herein are microbes engineered to express one or more cholesterol oxidoreductases (COR) or homologs thereof. In some embodiments, the engineered microbe is an engineered variant of a microbe within the phyla of Firmicutes, Bacteroidetes, Actinobacteria, Bacteroidetes, Proteobacteria, Fusobacteria, Verrucomicrobia, Euryarchaeota, or Ascomycota. In some embodiments, the engineered microbe is an engineered variant of a microbe within the genus *Corynebacterium, Bifidobacterium, Atopobium, Faecalibacterium, Clostridium, Roseburia, Ruminococcus, Dialister, Lactobacillus, Enterococcus, Staphylococcus, Streptococcus, Sphingobacterium, Bacteroides, Tannerella, Parabacteroides, Alistipes, Prevotella, Escherichia, Shigella, Desulfovibrio, Bilophila, Helicobacter, Fusobacterium, Pediococcus, Bacillus, Leuconostoc, Akkermansia, Methanobrevibacter, Propionibacterium, Coriobacteriaceae, Actinobacteria, Rikenellaceae, Lachnospiraceae, Firmicutes, Peptostreptococcaceae, Veillonella, Oscillospira, Dialister, Slackia, Eggerthella, Gordonibacter, Geobacter Alkaliphilus, Catenibacterium, Holdemania, Marvinbryantia, Symbiobacterium, Roseburia, Erysipelotrichaceae, Butyricicoccus, Sporobacter, Blautia, Dorea, Succinivibrio, Barnesiella, Biolophila, Eubacterium*, or *Saccharomyces*. In embodiments, the engineered microbe is an engineered variant of a *Lactobacillus, Bifidobacterium, Saccharomyces, Enterococcus, Streptococcus, Pediococcus, Leuconostoc, Bacillus*, or *Escherichia coli*. Engineered microbes can be formulated for delivery, in particular as an oral formulation. The engineered microbes are engineered to express a COR protein, and can optionally be engineered to express a cholesterol transporter and/or other enzyme involved in coprostanol formation, including but not limited to any described elsewhere herein and/or cholesterol oxidase, 3-oxo-Δ4-steroid 5β-reductase, and/or any others described elsewhere herein.

In particular embodiments, the engineered microbes may comprise a bacterium or bacteria formulated particularly for probiotic applications and engineered to comprise a COR protein or homolog thereof. The genus *Bacillus* includes Gram positive spore-forming aerobic or facultative aerobic members with claimed probiotic properties including: *B. subtilis, B. coagulans, B. subtilis, B. cereus*. The genus *Bifidobacterium* includes various Gram positive non-motile anaerobic bacteria. Strains of the genus *Bifidobacterium* may be used as probiotic bacteria and tend to have a variety of resistance mechanisms to bile salts. Lactobacilli may be used in some instances, including Lactobacilli such as: *Lactobacillus acidophilus, L. casei, L. paracasei, L. rhamnosus, L. delbrueckii* subsp. *bulgaricus, L. brevis, L. johnsonii, L. plantarum* and *L. fermentum*. Further, complete genome sequences of complete genome sequences are readily available: *Lactobacillus plantarum, L. johnsonii, L. acidophilus, L. sakei, L. bulgaricus, L. salivarius*. Makarova K, et al. Comparative genomics of the lactic acid bacteria. Proc. Natl. Acad. Sci. USA. 2006; 103:15611-15616. doi: 10.1073/pnas.0607117103. In certain instances, stability in the small intestine is fleeting, and thus may be effective in more regular dosing/supplementation. However, their properties of high tolerance to acid and bile, capability to adhere to intestinal surfaces, withstanding low pH, gastric juice may be useful in their choice as a probiotic strain. *Escherichia coli* of Gram-negative family Enterobacteriaceae can be used in probiotic preparations, in one embodiment, the *E. coli* is *Escherichia coli* Nissle 1917 (EcN). Optimized *E. coli* expression strains can be utilized using approaches, for example, as described in Makino et al., Microb. Cell Fact. 10:32 (2011); DOI: 10.1186/1475-2859-10-32/*Lactococcus* is a genus of Gram-positive lactic acid bacteria. The genera *Streptococcus* and *Enterococcus* are also part of the lactic acid bacteria including *Enterococcus durans* and *Streptococcus thermophilus*.

Cholesterol Oxidoreductase Homologs

As disclosed herein, microbes can be engineered to express one or more cholesterol oxidoreductase (COR) enzymes. In embodiments, the one or more COR homologs originate from phylum Firmicutes. In one aspect, the COR homologs originate from or be in the direct neighborhood or marker species of Cluster IV or cluster XIVa *Clostridium* group. See, e.g. Manson, et al., Adv. Exp. Med. Biol. 2008; 635:15-28, doi: 10.1007/978-0-387-09550-9_2; Frank et al., Proc Natl Acad Sci USA. 2007 Aug. 21; 104(34):13780-5; doi: 10.1073/pnas.0706625104, incorporated herein by reference in their entirety.

In embodiments, the one or more COR homologs originate from *Eubacterium*, in embodiments, *Eubacterium coprostanoligenes*, and in one aspect, *Eubacterium coprostanoligenes* HL (ATCC 51222). In embodiments, the COR is ECOP170 or a homolog thereof. The COR may comprise SEQ ID NO: 44.

In particular embodiments, the homolog has about 10%, e.g., by at least about 20%, by at least about 30%, e.g., by at least about 40%, by at least about 50%, e.g., preferably at least about 60%, at least about 70%, e.g., at least about 80%, at least about 90%, at least about 95%, such as by at least about 96%, 97%, 98%, 99% amino acid sequence identity to ECOP170 (SEQ ID NO: 44). In embodiments, the homolog has at least about 20%, at least about 30%, at least about 40%, at least about 50% at least about 60%, at least about 70%, at least about 80%, at least about 90%, at least about 95%, at least about 96%, 97%, 98%, 99% amino acid sequence identity to SEQ ID NO: 44 and comprises amino acids corresponding to S138, Y151, and/or K155 of ECOP170 (SEQ ID NO: 44). In embodiments, a COR homolog can be identified by its relation to the Cluster IV or Cluster XIVa *Clostridium* group, by its metabolism of cholesterol or related sterol in a sample using the metabolic pathway disclosed herein or related pathway, e.g. reduction of the Δ5-sterol. In embodiments, the presence of a MSF transporter or biotin transporter in close proximity aids in identification of COR homologs, see, e.g. FIG. 3. The COR homolog may be identified by its retention of conserved amino acid residues corresponding to S138, Y151, and K155 of ECOP170 (SEQ ID NO: 44).

In embodiments, the engineered microbe is selected from one or more of the sequences in Table 8. In embodiments, the engineered microbe is selected from one or more of the sequences in Table 1 and 2:

TABLE 1

25 Cholesterol oxidoreductases identified from the combined assembly of 7 human metagenomics cohorts

| Comments/ Closest CAG | Sequence ID | Sequence |
|---|---|---|
| | >G140183_ k105_49941_ 12 | MDKNWLNFKTVIVTGASSGMGKGIAEKLIKEHGCTVIGVARSEQKMQKFVEELGEYKDRFS YQLFDVSSLENWENFRKYLEDNRIQPDILINNAGILPKFDKFQHYTIEEIERAMNINFYSAVY SMHILLPLLLKSPSAAIINVDSSASLMSLAGTSVYSASKSALKSLTESLREELRGKCYVGIVCPG FTKTDIFRNQGSSDEKAQKMLNMVSTSCDKMVKLIMHGVGNQRELMVFGKDAAFMNYFG RIMPVLGGRLFSAVMKMSKLPLFDGVFKED (SEQ ID NO: 1) |
| | >G140899_ k105_13945_ 6 | MNTNWMNNKTVIITGASGGMGKGVAERLIKEHGCTVIGIARSEEKMKKVVEELGEYADKFS YQLFDVSVEQNWIDFVTYLRDNNIHPDVLINNAGILPKFDRFQNYTIDYIKKAMDINFYSAV YSIHALLPVLLESSTPAIINVDSSAALMTLAGTSVYSASKAALKSLSEALREELRGKCYVGIVCP GFTKTDIFRDQSSTDDKGTKMLNAVSTPCDKMVNMIMRDIKLKRPLGVHGFDAAFMNYFG RIMPVQGGRLFSTVMKVSKLPLFDPVFKD (SEQ ID NO: 2) |
| CAG:180 | >ERR2017635_ k103_ 44512_ 154 | MDQNWMNNTTVIVTGASGGMGKGIAESLIVDHGCTVIGIARSEEKMKKVVEELGPNAEKFS YKLFDVSVEQNWIDFAKYLEDNDIHPDILVNNAGILPKFDRFEHYSMADIEKAMNINFYSAV YSIHTLLPMILKSKTPGIINIDSSASLMSLAGTSVYSASKAALKSLSESLREELRGKCYVGIVCP GFTKTDIFRSQDASDAKGQKMLNAVSTSCDRMVKMIMHDIRTRRPLGVHGFDAAFMNYFG RLMPVLGGHIFSSVMKISKLPLFDPVFKD (SEQ ID NO: 3) |
| | >G140757_ k105_15337_ 2 | MWMQGKTVVITGASSGMGKGIAQRLIVDYGCNVIGIARSEQKMKKFVEELGFYAGKFSYRLF DVSVRENWENFAAELKENGTKIDVLINNAGILPKFKRFDRYTIEDIENVMNINFYSAVYGSKI LFDQLMESDTPAIINVDSSAALMALAGTSAYSASKSALKSLTEAMREEYRGKMYIACVCPGF TKTDIFRNQGETSGKGEKAMNMISTDCDKMVDMIVRGIAHHKALQVHGKDAFFMDVFSRL LPVNGPRLFSNVMRMAKLDLFDGVFKD (SEQ ID NO: 4) |
| | >MSMA26BX_ R_k105_ 8138_1 | MWMQGKTVVITGASSGMGKGIAEKLIKEYGCNVIGVARSEVKMKKFVEELGFYAGKFSYELF DVSVKENWEKFSQQLKDNGTKIDVLINNAGILPKFMRFDRCSIEDIEKVMNINFYSAVYGSK YLFDQLMESDTPAIINVDSSAALMSLAGTSAYSASKSALKSLSEAMREEYRGKMYVGIVCPGF TKTDIFRNQGETSGKGQKVMNMISTDCDKMVKMIVNGIAHQKALQVHGKDAWAMDIFGK LLPVNGSRLFSSVMRMANIDLFDGVFKD (SEQ ID NO: 5) |
| | >G48784_ k105_68315_ 28 | MWMQGKTVVITGASSGMGKGIAEKLIKEYGCNVIGVARSEAKMKKFVEELGFYAGKFSYQL FDVSVKENWEKFSQQLKDNGTKIDVLINNAGILPKFMRFDRCSIEDIEKVMNINFYSAVYGS KYLFDQLMESDTPAIINVDSSAALMSLAGTSAYSASKSALKSLSEAMREEYRGKMYVGIVCPG FTKTDIFRNQGETSGKGQKVMNMISTDCDKMVKMIVNGIAHQRALQVHGKDAWAMDIFG KLLPVNGSRLFSSVMRMANIDLFDGVFKD (SEQ ID NO: 6) |
| | >G89005_ k105_31711_ 1 | MACWLDGKTVVVTGASGGMGAGIAATLIKKHGCTVIGIARSEPKMLKFIDELGPTYASQFSY KLFDVSIKENWENFAQELQDNDTKIDILINNAGILPKFKRFDRYSYDEIEKAMNINFYSCIYS TKTLLPMLLESPTPGVINIDSSAALMTLAGTSMYSASKAALKGFTEALRVEFQGKMYVSLVC PGFTKTDIFRDQGTESNSKGQKVMDMISTDCDLMVKMIMKGIEFKAPMQVHGLDAHAMSI CNRIAPVYGSKLFSAVMRMANVDIFKEVFND (SEQ ID NO: 7) |
| | >G139953_ k105_6325_ 8 | MNECWLHGKTVVVTGASGGMGAGIAGTLIKKHGCTVIGVARNEKKMLKFIDELGDSYAKQF SYKLFDVSKKENWENFYQELRDNGVKVDILINNAGILPKFKRFDKYSYEEIDMAMNINFYSS VYSVKTMLPMLLESSTPAVINIDSSAALMTLAGTSMYSASKAALKGFTEALRIEFKDKMYVG LVCPGFTKTDIFRGQTGVNMDSGAKAMDMISTDCDKMVKMIMFGIEHKMPMQVHGFDAH AMSVANRLMPVYGSKLFSAVMRMANVDIFKEVFSD (SEQ ID NO: 8) |
| | >MSM5LLF6_ R_k105_ 38794_ 2 | MNTCWLQGKTVVVTGASGGMGAGIAATLIKKHGCTVIGVARNEKKMLHFIEELGETYAKQF SYELFDVSVKENWENFANELNEKGIKVDILINNAGILPKFKRFDKYSYDEIERAMNINFYSCV YSVKTMLPMLLKSSTPAIINIDSSAALMTLAGTSMYSASKAALKGFTEALRVEFQGKMYVGL VCPGFTKTDIFSGQGDADMSSGAKVMDMISTDCDKMVKMIMFGIEHKAPMQVHGFDAHA MSVFNRLMPVYGSKLFSSVMRMANVDIFKEVFSD (SEQ ID NO: 9) |
| | >G88790_ k105_50573_ 1 | MSTCWLQGKTVVVTGASGGMGAGIAATLIKKHGCTVIGVARNEKKMLKFVDELGETYAKQ FSYELFDVSSKENWEKFAEELQEKGVKVDVLINNAGILPKFKRFDRYSYEEIDRAMNINFYS CVYSVKTMLPMLLQSSTPAIINIDSSAALMTLAGTSMYSASKAALKGFTEALRVEFQGKMFV GLVCPGFTKTDIFSGQGDADMSNGAKVMDMISTDCDKMVKMIMFGIEHKTPMQVHGFDA HAMSVFNRLMPVYGSKLFSSIMRMANVDIFKEVFSD (SEQ ID NO: 10) |
| | >G48791_ k105_70309_ 15 | MSDCKCCVGGDWLSGKTVIVTGASGGMGAGIAATLIKKHACRVVGVARSETKMLKFIEELG PTYAEQFSYKLFDVSDKAAWESFAEELAEEGIRPSVLINNAGILPKFKRFDRYSYEEIERAMN INFYSCVYGVKTFLPVLLEEEDPAIINVDSSAALMTLAGTSMYSASKAALKGFTEALRVEFKN KMYVGLVCPGFTKTDIFRDQKNEGGKGQKVMDMISTDCDLMVKMIMFGIAHKRPMMVHG LDAHAMSVFNRLLPVKGSELFSLVMKVADIDLFNDVFKD (SEQ ID NO: 11) |

TABLE 1-continued

25 Cholesterol oxidoreductases identified from the combined assembly of 7 human metagenomics cohorts

| Comments/ Closest CAG | Sequence ID | Sequence |
| --- | --- | --- |
| Netherlands Specific Homologue | >ERR2017598_ k103_ 131885_ 26 | MSNCTNAICGDWLNGKTVIVTGASGGMGAGIAATLIKKHNCRVVGVARNEAKMLKFIEELG PMYKDQFSYKLFDVSSREAWENFAKELEEEGIVPSVLVNNAGILPKFKRFDRYSYDEIERAM NINFYSCVYGVKTFLPVLLTQDDPGIINVDSSAALMTLAGTSMYSSSKAALKGFTEALRVEFK GKCYVGLVCPGFTKTDIFRDQSNSGGKGQKVMDMISTDCDLMVKMIMFGIEHKRPMMVHG LDAHAMSVFNRLLPVAGSELFSAIMKMADIDLFSEVFKD (SEQ ID NO: 12) |
| CAG:251 | >ERR2017655_ k103_ 67238_ 7 | MSDFTKAICGDWLNGKTVIVTGASGGMGAGIAATLIKKHNCRVVGVARNEAKMLKFIEELG PMYKDQFSYKLFDVSSREAWENFASELAEEGIVPSVLVNNAGILPKFKRFDRYSEEIEKAM NINFYSCVYGVKTFLPVLLTQDDPGIINVDSSAALMTLAGTSMYSSSKAALKGFTEALRVEFR GKCYVGLVCPGFTKTDIFRDQSNAGGKGQKVMDMISTDCDLMVKMIMFGIEHKRPMMVHG LDAHAMSIFNRLLPVAGSELFSAIMKMADIDLFSEVFDD (SEQ ID NO: 13) |
| CAG:341 | >ERR2017515_ k79_ 109830_ 2 | MSDYTKALCGDWLNGKTVIVTGASGGMGAGIAATLIKKHNCRVVGVARNEAKMLKFIEELG PMYKDQFSYKLFDVSSREAWENFASELEEEGIVPSVLVNNAGILPKFKRFDRYSEEIEKAM NINFYSCVYGVKTFLPVLLTQDDPGIINVDSSAALMTLAGTSMYSSSKAALKGFTEALRVEFK GKCYVGLVCPGFTKTDIFRDQSNAGGKGQKVMDMISTDCDLMVKMIMFGIEHKRPMMVHG LDAHAMSIFNRLLPVAGSELFSAIMKMADIDLFSEVFDN (SEQ ID NO: 14) |
| | >MSM9VZOK_ R_k105_ 36925_ 1 | MYCWLDSKTVVVTGASGGMGAGIAATLIKKHGCKVIGVARSESKMLKFIEELGPTYAEQFSY KLFDVSVRENWENFYNELVEEGVQVDVLINNAGILPKFKRFDRYSYEEIERAMNINFYSCVY SVKTFLPMLLKSSTPGIVNIDSSAALMSLAGTSMYSASKAALKGFTEALREEFRGKCYVGLVC PGFTKTDIFRSQDEGSGKGEKVINMISTNCDTMVKMIMFGIEHKQALQIHGMDAHAMSVFG KLLPVNGSRLFSAIMKAADIDLFAEVFKNE (SEQ ID NO: 15) |
| CAG:217 | >G104929_ k105_46920_ 10 | MYCWLDGKTVVVTGASGGMGAGIAATLIKKHGCTVIGVARSEPKMLKFIEELGPTYAQQFSY KLFDVSVKENWENFYNELVEEGVQVDVLINNAGILPKFKRFDRYSDEEIERAININFYSCVY SVKTFLPMLLQSTDPGIVNIDSSAALMSLAGTSMYSASKAALKGFTEALREEFRGKCYVGLVC PGFTKTDIFRGQSNAGGKGEKVINMISTDCDLMVKMIMFGIEHKQALQIHGVDAHAMSVFG KLLPVNGSRLFSAVMKAADIDLFKEVFKDDAELAE (SEQ ID NO: 16) |
| | >G140022_ k105_20980_ 2 | MSNCWLNGKTCVVTGASGGMGAGIAATLIKKHGCKVIGVARSEPKMIKFIEELGPTYAEQFS YKLFDVSKKENWDNFVEELQADGVKVDILVNNAGILPKFKRFDRYDMDEIERAININFYSCV YSIKAMLPMLLESPEGGIVNIDSSAALMSLAGTTMYSASKAALKGFTEALREEFRGKLFVGLV CPGFTKTDIFRDQKNEGGKGQKIMDMISTDCDLMVKMIMFGLEHKQQLQIHGMDAHAMSV FGKLLPVNGSRLFSAIMKAADIDLFKDVFND (SEQ ID NO: 17) |
| CAG:528 | >HSM67VEO_ R_k105_ 8042_1 | MSNCWLSGKTCVVTGASGGMGAGIAATLIKKHGCKVIGVARSEPKMKKFIEELGPTYAEQFS YKLFDVSKNENWVNFAQELKDEGVKLVNNAGILPKFKRFDRYEMDEIEKAININFYSCV YSIKALLPMLLESNDPGIVNIDSSAALMSLAGTSMYSASKAALKGFTEALREEFRGKIYVGLV CPGFTKTDIFRDQKNDGGKGQKVMDMISTDCDLMVKMIMFGIEHKQALQIHGMDAHAMS VFGKLLPVNGSRLFSAIMKAADIDLFNDVFRN (SEQ ID NO: 18) |
| | >G72720_ k105_63499_ 8 | MSNCWLSGKTCVVTGASGGMGAGIAATLIKKHGCKVIGIARSEPKMKKFIEELGPTYAEQFS YKLFDVSKNENWVNFAQELKDEGVKIDVLVNNAGILPKFKRFDRYEMDEIEKAININFYSCV YSIKALLPMLLESNDPGIINIDSSAALMSLAGTSMYSASKAALKGFTEALREEFRGKVYVGLV CPGFTKTDIFRDQKNDGGKGQKVMDMISTDCDLMVKMIMFGIEHKQALQIHGMDAHAMS VFGKLLPVNGSRLFSAIMKAADIDLFNDVFRN (SEQ ID NO: 19) |
| | >G88988_ k105_31485_ 1 | MSNWLDGKTCIVTGASGGMGAGIAATLIKKHGCRVIGVARSETKMLKFIEELGPTYAKQFSY KLFDVSKNENWVNFVKELEEEDINVDVLVNNAGILPKFKRFDRYEMDEIEKAININFYSCVY SIKALLPMLMKSSDPGIINIDSSAALMSLAGTSMYSASKAALKGFTESLREEFRGKIYVGLVCP GFTKTDIFRDQKNDGGKGQKVMDMISTNCDIMVKLIMFGIENKQALQVHGMDAHAMNIFG KLFPVNGSRLFSAIMKAADIDLFSEVFKD (SEQ ID NO: 20) |
| | >G36365_ k105_42273_ 10 | MSNWLDGKTCIVTGASGGMGAGIAATLIKKHGCRVIGVARSETKMLKFIEELGPTYAEQFSY KLFDVSKNENWVNFVKELEEEENINVDVLVNNAGILPKFKRFDRYEMDEIEKAININFYSCVY STKALLPMLMKSSDPGIINIDSSAALMSLAGTSMYSASKAALKGFTESLREEFRGKIYVGLVC PGFTKTDIFRDQKNDGGKGQKVMDMISTNCDTMVKLIMFGIEHKQALQVHGMDAHAMNV FGKLLPVNGSRLFSAIMKAADIDLFSEVFKD (SEQ ID NO: 21) |
| | >G141014_ k105_89139_ 1 | MSNWLDGKTCIVTGASGGMGAGIAATLIKKHGCRVIGIARSEPKMLKFIEELGPTYAEQFSYK LFDVSKNENWTKLVEELEEEDIQVDVLINNAGILPKFKRFDRYDMDEIENAININFYSCVYSI KALLPMLLKSSDPGIVNIDSSAALMSLAGTSMYSASKAALKGFTESLREEFRGKIYVGLVCPG FTKTDIFRGQKNDGGKGQKVIDMISTDCDLMVKLIMFGIEHKQALQIHGVDAHAMNIFGKL LPVNGSRLFSAVMKAADIDLFSEVFKD (SEQ ID NO: 22) |
| | >M5M79H9K_ R_k105_ 2566_ 3 | MSNWLDGKTCIVTGASGGMGAGIAATLIKKHGCRVIGIARSEPKMLKFIEELGPTYAQQFSY KLFDVSKNENWINLVSELEENNIQVDVLVNNAGILPKFKRFDRYDMSEIENAININFYSCVYS IKALLPMLMKSSDPGIINIDSSAALMSLAGTSMYSASKAALKGFTESREEFRGKVYVGLVCP GFTKTDIFRDQKNAGGKGQKVINMISTDCDLMVKMIMFGIEHKQALQVHGVDAHAMNIFG KLLPVNGSRLFSAVMKAADIDLFSEVFKD (SEQ ID NO: 23) |

TABLE 1-continued

25 Cholesterol oxidoreductases identified from the combined assembly of 7 human metagenomics cohorts

| Comments/ Closest CAG | Sequence ID | Sequence |
|---|---|---|
|  | >G139962_k105_44646_2 | MSNWLDGKTCIVTGASGGMGAGIAATLIKKHGCRVIGIARSEPKMLKFIEELGPTYAEQFSYK LFDVSKNENWIQLVSELEEENIQVDVLVNNAGILPKFKRFDRYDMDEIEKAININFYSCVYSI KALLPMLMKSSDPGIINIDSSAALMSLAGTSMYSASKAALKGFTESLREEFRGKVYVGLVCPG FTKTDIFRDQKNDGGKGQKVINMISTDCDLMVKLIMFGIEHKQALQIHGVDAHAMNIFGKL LPVNGSRLFSAVMKAADIDLFSEVFKD (SEQ ID NO: 24) |
| CAG:678 | >MSMA26AX_R_k105_23254_2 | MSNWLDGKTCIVTGASGGMGAGIAATLIKKHGCRVIGIARSEPKMLKFIEELGPTYAEQFSYK LFDVSKNENWVDLAAELEKQNIQVDVLVNNAGILPKFKRFDRYDMDEIEKAININFYSCVYS IKALLPMLMKSSDPGIINIDSSAALMSLAGTSMYSASKAALKGFTESLREEFRGKVYVGLVCP GFTKTDIFRDQKNDGGKGQKVINMISTDCDLMVKLIMFGIEHKQALQIHGVDAHAMNIFGK LLPVNGSRLFSAVMKAADIDLFSEVFKD (SEQ ID NO: 25) |
| Msp_0832 | NODE_2899_length_3227_cov_2.929382_2 | MSNCWLNGKTCIVTGASGGMGAGIAATLIKKHGCKVIGVARSEPKMKKFIEELGPTYAEQFS YKLFDVSKNENWVEFAEEELKEQGVKVDVLVNNAGILPKFKRFDRYDMQEIENAININFYSCI YSIKAFLPMLLESDDPGIINIDSSAALMSLAGTSIYSASKAALKGFTESLREEFRGKVYVGLVCP GFTKTDIFRDQKNEGGKGEKIMNNISTDCDLMVKMIMFGIAHKQALQIHGMDAHAMSVFG KLLPVSGSRLFSAIMKAADIDLFDDVFKD* (SEQ ID NO: 26) |

TABLE 2

Figure 15:
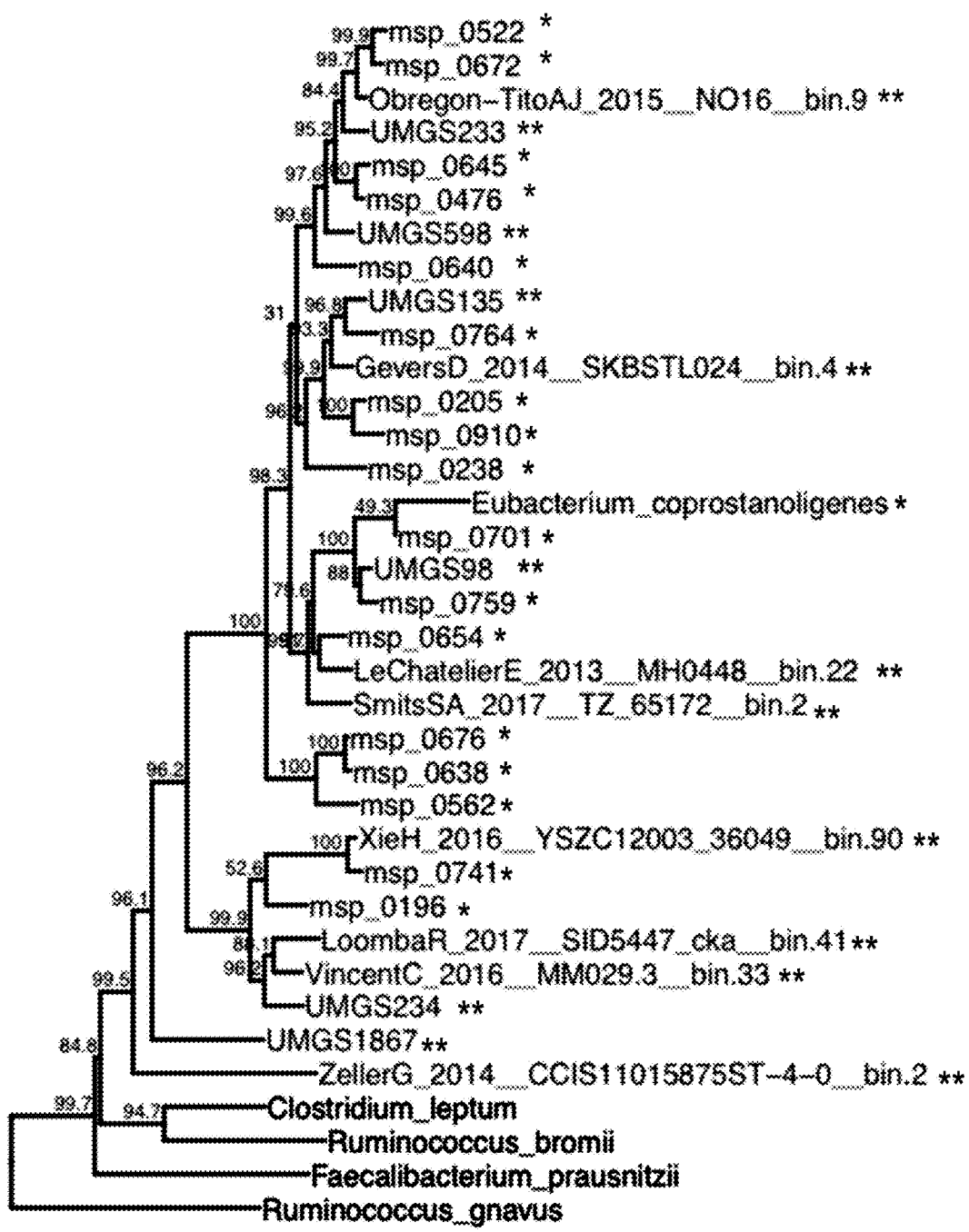
FIG. 15 Phylogenetic neighborhood of *Eubacterium coprostanoligenes* including high quality genomes of COR-encoding MSPs (*) and additional 14 COR-encoding species from Pasolli and Almeida (**). Tree was generated using PhyloPhlAn (Segata et al. 2013).

Additional COR genes and polypetides from metagenomic species.
(See e.g. **species from FIG. 15)

| Genome | COR gene | AA seq |
|---|---|---|
| GeversD_2014_SKBSTL024_bin.4 | GeversD_2014_SKBSTL024_bin.4.NODE_187_length_79056_cov_12.9466_75 | MTDIKNCVGSDWLSGKTVIVTGASGGMGAGIAATLIKKHGCHVIGVARNEAKMLKFIDE LGPTYAEQFSYKLFDVSDKEHWEDFAKELEEAGIRPSVLINNAGILPKFKRFDRYSYDEI ERAMNINFYSCVYGVKTFLPVLLQQDDPAIINVDSSAALMTLAGTSMYSASKAALKSFTE ALRVEFKGRMYVGLVCPGFTKTDIFRDQKNDGGKGQKVMDMISTDCDRMVKMIMFGI EHKRPRMVHGFDAHAMSVFNRLLPVSGSELFSMIMKAADIDLFDEVFKN (SEQ ID NO: 27) |
| LeChatelierE_2013_MH0448_bin.22 | LeChatelierE_2013_MH0448_bin.22.NODE_1125_length_28240_cov_3.7681_7 | MANWLDGKTVVVTGASGGMGAGIAASLIKNHGCTVIGVARSEPKMLKFIEELGDTYAH KFSYKLFDVSVKENWENFAEELKANGTKIDILVNNAGILPKFKRFDRYSYDEIDKAMNI NFYSCVYSTKTLLPIILESETPGIINIDSSAALMTLAGTSMYSASKAALKGFTEALRTEFKG KMYVGLVCPGFTKTDIFRNQGQTESNNKGAKVINMISTDCDLMVKMIMFGIEHKAPMQ VHGFDAHAMSIFNRLMPVAGSELFSAIMKAAKVDLFDEVFRD (SEQ ID NO: 28) |
| LoombaR_2017_SID5447_cka_bin.41 | LoombaR_2017_SID5447_cka_bin.41.NODE_655_length_18959_cov_9.48154_18 | MDKNWLNFKTVIVTGASSGMGKGIAEKLIKVHGCNVIGIARSEKKMKTFVEELGEYADR FSYQLFDVSSLENWVDFRQYLEDNHIKPDILINNAGILPKFDKFQHYTIEEIESAMNINFY SAVYSMHTLLPLLLKSPSAAIINVDSSAALMSLAGTSVYSASKSALKALTESMREELRGK CYVGIVCPGFTKTDIFRNQGSSDEKAQKMLNMVSTSCDKMVKLIMNGIGKQHELMVFG KDAAFMNYFGRMMPVLGGRLFSAVMKMSKLPLFDGVFKED (SEQ ID NO: 29) |
| Obregon-TitoAJ_2015_NO16_bin.9 | Obregon-TitoAJ_2015_NO16_bin.9.NODE_70_length_99956_cov_95.9141_72 | MSNCWLDGKTCIVTGASGGMGAGIAATLIKKHGCRVIGVARSEPKMLKFIEELGPVYAE QFSYKLFDVSKNENWIEFAEEELKENDIKVDVLVNNAGILPKFKRFDRYDMDEIQKAIDI NFYSCVYSIKALLPMLMESDTPGIINIDSSAALMSLAGTSMYSASKAALKSFTESLREEFR GKIYVGLVCPGFTKTDIFRDQKNDGGKGQKVIDMISTDCDLMVKMIMFGIEHKQALQIH GIDAHAMNLFGKLLPVNGSRLFSAVMKAADIDLFSEVFKD (SEQ ID NO: 30) |
| SmitsSA_2017_TZ_65172_bin.2 | SmitsSA_2017_TZ_65172_bin.2.NODE_1437_length_5605_cov_11.0000_ID_11320_3 | MECWLNNKTVVVTGASGGMGAGIAATLIKKHNCTVIGVARSEPKMLKFIEELGADYAS KFSYRLFDVSVKENWESFAQELKDNGVKVDILVNNAGILPKFKRFDRYSYDEIKAMNI NFYSCIYSTKTLLPMLLESSSPAVINIDSSAALMTLAGTSMYSSSKAALRAFTEALRVEFA GKMYVGLVCPGFTKTDIFRNQGAESNSNGQKVMNMISTDCDIMVKRIMRGIENKYPMQ VRGFDAHAMSIANRVAPVYGSKLFSSVMRMANVDIFKEVFSD (SEQ ID NO: 31) |
| XieH_2016_YSZC12003_36049_bin.90 | XieH_2016_YSZC12003_36049_bin.90.NODE_65_length_172820_cov_17.3262_160 | MNTNWMNNKTVIITGASGGMGKGVAERLIKEHGCTVIGIARSEEKMKKVVEELGNYAD KFSYQLFDVSVEQNWLDFVDYLKENNIHPDVLINNAGILPKFDRFQNYSIDYIKKAMDI NFYSAVYSIHALLPLLLESSAPAIINVDSSAALMTLAGTSVYSASKAALKSLSEALREELRG KCYVGIVCPGFTKTDIFRDQSATDDKGTKMLNAVSTPCDKMVNIMRDIKFKRPLGVH GFDAAFMNYFGRIMPVQGGRLFSAVMKVSKLPLFDPVFKD (SEQ ID NO: 32) |
| VincentC_2016_MM029.3_bin.33 | VincentC_2016_MM029.3_bin.33.NODE_17_length_85923_cov_16.0000_ID_13093_1 | MDKNWLDNKTVIVTGASSGMGKGITEKLIKEHGCKVLGVARSEKKMEALVAELGEYAS QFSYQLFDVSVRENWENYVAYLNENGIKPDVLINNAGILPKFDRFEHYSVEDIEKAMNI NFYSAVYSMHALLPLLLESSSPAIINIDSSAALMSLAGTSVYSASKAALKALTESMREEMR GRCYIGIVCPGFTKTDIFRNQGSSDEKAQKMLNMVSTSCERMVKLIMNGIGHQRSLMVF GPDAGFMNYFGRLMPVTGGRLFSAVMKASKLPLFDGVFKD (SEQ ID NO: 33) |

TABLE 2-continued

Additional COR genes and polypetides from metagenomic species.
(See e.g. **species from FIG. 15)

| Genome | COR gene | AA seq |
|---|---|---|
| ZellerG_2014_CCIS11015875ST-4-0_bin.2 | ZellerG_2014_CCIS11015875ST-4-0_bin.2.NODE_1457_length_13273_cov_6.76297_3 | MKNNWLNNKTVIVTGASSGIGRGITLKLIREYNCRVLGIARSKEKMKSLTNELGSDSENF<br>SYLLFDVSKRENWKSFAEYIREKGIKPDILINNAGILPEFKKAESCSCEETERTMNINFYG<br>AVYSMKELLPIILDSPSPAVVNIDSSAALMPLAGTSVYSASKAALKAYTEAVREELRGRCY<br>VGVICPGFTQTDIFRSQNLTEEREQKIIGAVSTSLDYAVKRILKSIAKKRELTVIGADAKF<br>MSIFGRLMPVKCGRAVSRVLKKSGFKLFDGVFK (SEQ ID NO: 34) |
| UMGS135 | UMGS135.NODE_58_length_105574_cov_11.399359_10 | MSDCKCCNGDWLSGKTVIVTGASGGMGAGIAATLIKKHGCQVVGVARSESKMLAFIEEL<br>GPTYAEQFSYKLFDVSVKENWENFAKELEEEGIVPSVLINNAGILPKFKRFDRYSYDEIE<br>RAMNINFYSCVYGVKTFLPVLLQQENPAIINIDSSAALMTLAGTSMYSASKAALKGFTEA<br>LRVEFKGKMYVGLVCPGFTKTDIFRDQKNDGGKGQKVMDMISTDCDLMVKMIMFGIE<br>HKRPMMVHGLDAHAMSIFNRMLPVKGSELFSLVMKVADIDLFNDVFKD (SEQ ID NO: 35) |
| UMGS98 | UMGS98.NODE_66_length_99520_cov_4.787935_67 | MSECWLHGKTVVVTGASGGMGAGIAATLIKKHGCTVIGVARSESKMLKFIDELGEEYAK<br>QFSYKLFDVSVRENWESFYQELKDNGTKVDVLINNAGILPKFKRFDKYSYEEIDMAMNI<br>NFYSSVYSVKTMLPILLESSTPAVINIDSSAALMTLAGTSMYSASKAALKSFTEALRLEFR<br>GRMYVGLVCPGFTKTDIFRGQTGVNMDSGAKAMDMISTDCDKMVKMIMFCIEHKMPM<br>QVHGFDAHAMSVANRIAPVYGSKLFSAVMRMANVDIFKEVFSD (SEQ ID NO: 36) |
| UMGS233 | UMG5233.NODE_1257_length_7712_cov_13.641243_8 | MSNCWLNGKTCIVTGASGGMGAGIAATLIKKHGCKVIGVARSEPKMKKFIEELGPTYAE<br>QFSYKLFDVSKNENWVEFAEELKEQGVKVDVLVNNAGILPKFKRFDRYDMQEIENAINI<br>NFYSCIYSIKAFLPMLLESDDPGIINIDSSAALMSLAGTSIYSASKAALKGFTESLREEFRG<br>KVYVGLVCPGFTKTDIFRDQENEGGKGEKIMNMISTDCDLMVKMIMFGIAHKQALQIH<br>GMDAHAMSVFGKLLPVSGSRLFSAIMKAADIDLFDDVFKD (SEQ ID NO: 37) |
| UMGS598 | UMGS598.NODE_337_length_48542_cov_5.386351_4 | MSDCWLNGKTCVVTGASGGMGAGIAATLIKKHGCKVIGVARSEPKMLKFIEELGPAYAE<br>QFSYKLFDVSNNDNWVEFKKELEEQGVQVDILVNNAGILPKFKRFDRYDMDEIERAINI<br>NFYSCVYSTKAFLPMLLQSDDPGIINVDSSAALMSLAGTSMYSASKAALKGFTESLREEF<br>RGKVFVGLVCPGFTKTDIMRDQVAQGGKGAKIIDMISTDCDLMVKMIMFGIAHKQHLQI<br>HGVDAHAMSVFGKLLPVNGSRLFSAVMKAADVDLFNEVFKD (SEQ ID NO: 38) |
| UMGS234 | UMG5234.NODE_456_length_17773_cov_5.999210_5 | MDQNWLNNKTVIVTGASSGMGKGITEKLIKEHGCTVLGVARSQQKMEALVAELGEYAD<br>KFSYQLFDVSDRANWDNYLAYLQENNIQPDVLINNAGILPKFDKFQHYSIEEIEKAMNI<br>NFYSAVYSMHALLPLLLKSSSPAIINIDSSAALMSLAGTSVYSASKAALKSLTESMREELR<br>GKCYVGIVCPGFTKTDIFRNQGSSDEKAQKMLNMVSTSCDRMVNLIMNGISKQHSLMV<br>FGMDAAFMNYFGRLLPVQGGRLFSAVMKMSKLPLFDGIFKED (SEQ ID NO: 39) |
| UMGS1867 | UMG51867.NODE_4010_length_3846_cov_3.064363_1 | MIYENWLTRATVVITGASGGLGKGIAMKLIERYDCTVIGIARNEEKMKTVVADLGDKAD<br>HFSYQLFDVSIEENWKNFAEYLKENDIHPDILINNAGILPKFDRFGNYTIEYIKKAMDINF<br>YSAVYSMHYLMPILLKSSKAAIVNVSSSAALCSLAGTSVYTASKAALKGLTEAAREEYRG<br>ECYIGLVCPGFTKTDIFSSQGNGDGSDSFANKAVEMISSSCDSMVRKIVHGISHKKDIMVY<br>GVDAKLMEDGNRLAKVGTSKI (SEQ ID NO: 40) |

In embodiments, the engineered microbe is engineered to express one or more of the cholesterol oxidoreductase proteins selected from SEQ ID NOs: 1-40, 42. In an embodiment, the COR proteins or a homolog thereof comprise amino acids corresponding to S138, Y151, and/or K155 of ECOP170 (SEQ ID NO:43).

In particular embodiments, the engineered microbes of the present invention are engineered to further express a cholesterol transporter. In embodiments, the cholesterol transporter may comprise an MFS transporter, see, e.g. FIG. 3. In embodiments, the transporter engineered into a microbe could aid in research, screening, and further methods of reduction in cholesterol transport. The engineered microbe may comprise a cholesterol transporter known in the art. In example embodiments, the transporter is an intestinal sterol transporter, for example Niemann-Pick C1-like 1 proteins. See, e.g. Bays et al., Expert Rev Cardiovasc Ther. 2009; 6(4):447*470 doi:10.1586/14779072.6.4.447. Similarly, liver transporter allows for secretion via ATP binding cassette A1 (ABCA1) transporter. See, e.g. V. Charlton-Menys, et al. Human cholesterol metabolism and therapeutic molecules, Exper. Phys., doi: 10.1113/expphysiol.2006.035147.

Cholesterol Oxidoreductase Substrates

Cholesterol oxidoreductase substrates as disclosed herein may comprise sterols, an alcohol of steroid compounds which comprise a four hydrocarbon ring structure made up of three 6-carbon rings and a 5-carbon ring. Steroid structures comprising substitutions on any of the 6-carbon rings or 5-carbon ring and/or double bonds in the A ring of the steroid composition are also contemplated.

Sterols may comprise phytosterols, zoosterols and/or mycosterols. In certain embodiments, the COR substrate comprises a 5,6 double bond on the B ring of a sterol or steroid, i.e. $\Delta 5$-sterols or $\Delta 5$-steroids. COR substrates comprising methyl sterols and dimethylsterols are also contemplated for use in some embodiments. Methyl sterols are herein defined as sterols comprising a methyl group at carbon-4 of the A-ring of the molecule and are alternatively referred to at triterpenyl alcohols. Dimethyl sterols similarly comprise substitution at carbon-4 in the A ring of the molecule.

In embodiments, the COR substrate is cholesterol. Cholesterol is the major precursor for the synthesis of vitamin D, of the various steroid hormones, including cortisol, cortisone, and aldosterone in the adrenal glands, and of the sex hormones progesterone, estrogen, and testosterone. Cholesterol is a cholestanoid consisting of cholestane having a double bond at the 5,6-position of the B ring as well as a 3beta-hydroxy group on the A ring. Intestinal bacteria are also known to transform cholic acid and chenodeoxycholic acid into 15-20 different bile acid metabolites.

Embodiments can include delivery of the reaction product of a cholesterol oxidoreductase substrate, or cholesterol oxidoreductase, and hence compounds which allow for reduction of the 5,6-double bond to compounds that could prove therapeutically useful, including, but not limited to, reduction of cholesterol serum levels or cholesterol uptake, include compounds with a Δ5 bond.

In embodiments, the COR substrate comprises the 5,6-double bond of cholesterol. In certain embodiments, the COR enzymes are involved in the reduction of the 5,6-double bond in beta-sitosterol, campesterol and stigmasterol. Other Δ5 sterols include Δ5-Avenasterol and Brassicasterol.

Coprostanol, Cholesterone and/or Coprostanone

Coprostanol, also referred to as coprosterol, is a saturated analog of cholesterol (C27H48O). While sharing the same basic structure as cholesterol, it lacks the 5,6-double bond and it has an additional hydrogen atom at position 5, with a cis-oriented A/B ring structure. In embodiments, coprostanol is a reaction product when cholesterol is the substrate of a COR protein of the present invention. In embodiments, cholestanone and/or coprostanone is the product of a COR protein when cholesterol is the substrate.

In embodiments, coprostanol can be administered to reduce serum total cholesterol and/or triglycerides. In embodiments, a COR protein or homolog thereof, optionally provided via a naturally occurring microbe, and engineered microbe expressing the protein, or a probiotic comprising the COR protein, to increase coprostanol, cholesterone, and/or coprostanone. In embodiments, the COR protein or homolog thereof, optionally provided via a naturally occurring microbe, and engineered microbe expressing the protein, or a probiotic comprising the COR protein to reduce a sterol substrate to produce its corresponding ketone. In embodiments, compounds in the pathway for the sterol can be administered to a subject to reduce triglycerides or total serum cholesterol and/or cholesterol uptake; in particularly preferred embodiments compounds in the metabolic pathway for cholesterol are provided, in embodiments, the compounds are cholestenone, coprostanone and/or coprostanol. Intermediates in the pathways for beta-sitosterol, campesterol, stigmasterol and other Δ5 sterols such as Δ5-Aneasterol and Brassicasterol may also be utilized.

Bacteria able to reduce cholesterol to coprostanol are difficult to elucidate. Strains with these properties have been assigned to *Eubacterium*, and *Bacteroides* sp. strain D8. *Bifidobacterium, Clostridium*, and *Lactobacillus* have been reported as functioning in this capacity in vitro. Bacterial phylotypes from Lachnospiraceae and Ruminococcaceae families have also been associated with high coprostanol levels in healthy humans. Antharam, V. C., et al. An Integrated metabolomic and microbiome analysis identified specific gut microbiota associated with fecal cholesterol and coprostanol in *Clostridium difficile* Infection. PLoS ONE 2016, 11, e0148824.

Probiotic

Engineered microbes as described herein can also be utilized in probiotic applications. In particular embodiments, the probiotic is formulated for oral delivery, optionally a powder, bolus gel, capsule, liquid, or foodstuff. In embodiments, the foodstuff can be formulated as described, for example, in U.S. Pat. No. 6,787,151. The one or more microbes can be provided in a probiotic composition in an effective amount to reduce triglycerides and/or total cholesterol levels in the gut and/or blood.

In some embodiments, the probiotic can further comprise a prebiotic, see, e.g., Ooi, L.-G. & Liong, M.-T. Cholesterol-lowering effects of probiotics and prebiotics: a review of in vivo and in vitro findings. Int. J. Mol. Sci. 11, 2499-2522 (2010). Exemplary prebiotics include oligosaccharides (isomaltooligosaccharides, lactosucrose, xylooligosaccharides and glucooligosaccharides), sugar alcohols and polysaccharides (starch, resistant starch and modified starch), fructooligosaccharides, inulin, oligofructose, lactulose, and galactooligosaccharides.

Probiotic compositions comprising one or more microbes encoding one or more COR enzymes are provided herein. The one or more microbes of the probiotic composition can be from the phylum Firmicutes. In other embodiments, the microbes are species in the direct neighborhood or marker species for *Clostridium* cluster IV and cluster XIVa, see, e.g. FIG. 3, 19A. In embodiments, the IsmA-encoding species can be identified from human gut microbiomes. In particular embodiments, the one or more microbes are selected from the Metagenomic Species (MSP) MSP_0701 (SEQ ID NO: 9), MSP_0759 (SEQ ID NO: 8), MSP_0654 (SEQ ID NO: 7), MSP_0205 (SEQ ID NO: 13), MSP_0421 (SEQ ID NO: 14), MSP_0764 (SEQ ID NO: 11), MSP_0238 (SEQ ID NO: 16), MSP_0522 (SEQ ID NO: 24, 25), MSP_0672 (SEQ ID NO: 21), MSP_0602 (SEQ ID NO: 23), MSP_0645 (SEQ ID NO: 19), MSP_0476 (SEQ ID NO: 18), MSP_0640 (SEQ ID NO: 17), MSP_0676 (SEQ ID NO: 5), MSP_0638 (SEQ ID NO: 6), MSP_0562 (SEQ ID NO: 4), MSP_0196 (SEQ ID NO: 3), MSP_0832 (SEQ ID NO:26) and MSP_0741 (SEQ ID NO: 2). In embodiments, the probiotic composition may comprise *Eubacterium*, preferably, *Eubacterium coprostanoligenes*, more preferably, *Eubacterium coprostanoligenes* HL (ATCC 51222). In embodiments, the probiotic composition may comprise ECOP1070 (SEQ ID NO: 44).

Examples of engineered probiotics using a safe host bacterium to deliver a protein or contribute a metabolic activity may comprise *E. coli* Nissle 1917, see, e.g. Kurtz et al., Science Transl. Med. 11:475, 16 Jan. 2019; DOI: 10.1126/scitranslmed.aau7975. *Lactococcus lactis* has also been utilized for probiotic administration, see, e.g. Cook et al, Front. Immun. "*Lactococcus lactis* as a Versatile Vehicle for Tolerogenic Immunotherapy," 17 Jan. 2018; DOI: 10.3389/fimmu.2017.01961. *Lactobacillus* gasseri has been engineered to express an anti-inflammatory protein from *S. thermophilus* to reduce colitis symptoms and is thus a useful species for probiotic applications. See, e.g. Carroll et al., Am J. Phys., Oct. 1, 2007; DOI: 10.1152/ajpgi.00132.2007. Engineered probiotics, natural microbes producing enzyme and/or purified enzymes have been administered in treatment of *C. difficile* infection, see, e.g. Mullish et al, Gut 2019:0:1-10. DOI:10.1136/gutnjl-2018-317842, and those approaches can be adapted for use with the microbes, COR proteins and probiotics of the current disclosure. Similarly, administration of *L. rhamnosus* as a probiotic has been used in regulation of cholesterol metabolism. See, Park S, Kang J, Choi S, Park H, Hwang E, Kang Y, et al. (2018) Cholesterol-lowering effect of *Lactobacillus rhamnosus* BFE5264 and its influence on the gut microbiome and propionate level in a murine model. PLoS ONE 13(8): e0203150; doi: 10.1371/journal.pone.0203150.

The engineered microbes may be engineered to inducibly or constitutively express one or more COR enzymes, and optionally one or more enzymes in the cholesterol metabolic pathway described herein. In embodiments, the engineered microbes can be designed with a kill switch that responds to environmental cues. See, e.g. Stirling et al., Rational Design of Evolutionarily Stable Microbial Kill Switches *Molecular Cell* 68:686-697, Nov. 16, 2017. Temperature sensitive mutants can be utilized to control growth in a temperature-dependent manner. See, e.g. Stirling at 691-692. In one embodiment, the engineered microbes can be engineered using CRISPR systems.

CRISPR-Cas Modification

In some embodiments, a polynucleotide of the present invention, or a polynucleotide encoding a polypeptide as described elsewhere herein, can be modified using a CRISPR-Cas and/or Cas-based system.

In general, a CRISPR-Cas or CRISPR system as used in herein and in documents, such as International Patent Publication No. WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g. Shmakov et al. (2015) "Discovery and Functional Characterization of Diverse Class 2 CRISPR-Cas Systems", Molecular Cell, DOI: dx.doi.org/10.1016/j.molcel.2015.10.008.

CRISPR-Cas systems can generally fall into two classes based on their architectures of their effector molecules, which are each further subdivided by type and subtype. The two class are Class 1 and Class 2. Class 1 CRISPR-Cas systems have effector modules composed of multiple Cas proteins, some of which form crRNA-binding complexes, while Class 2 CRISPR-Cas systems include a single, multi-domain crRNA-binding protein.

In some embodiments, the CRISPR-Cas system that can be used to modify a polynucleotide of the present invention described herein can be a Class 1 CRISPR-Cas system. In some embodiments, the CRISPR-Cas system that can be used to modify a polynucleotide of the present invention described herein can be a Class 2 CRISPR-Cas system.

CRISPR Systems

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g, Shmakov et al. (2015) "Discovery and Functional Characterization of Diverse Class 2 CRISPR-Cas Systems", Molecular Cell, DOI: dx.doi.org/10.1016/j.molcel.2015.10.008.

Class 1 Systems

Figure 5:
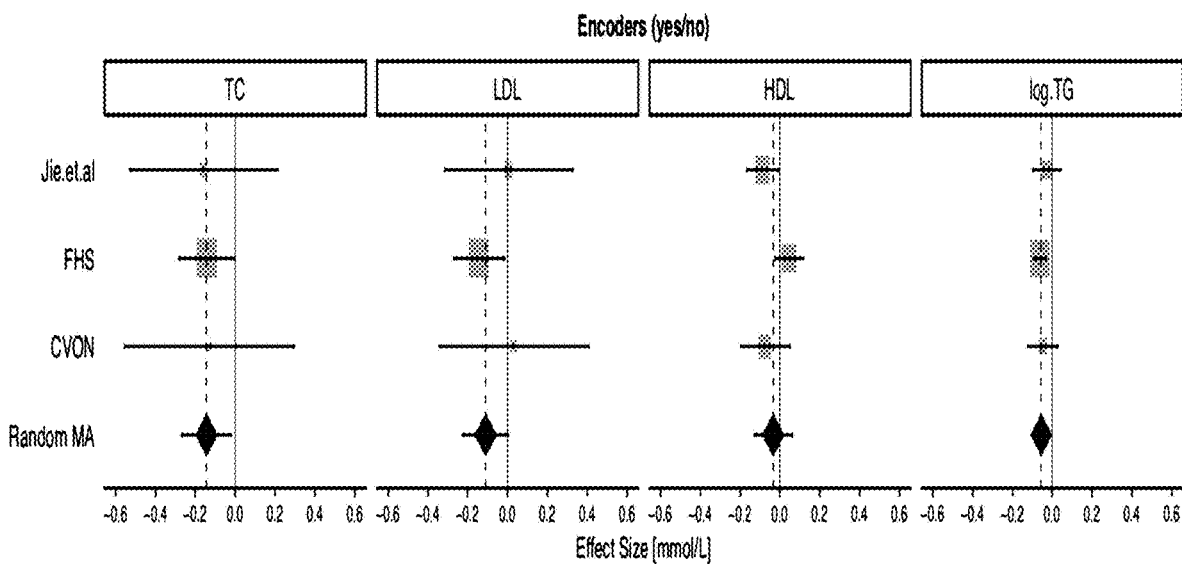
FIG. 5 Meta-analysis results for associations of serum lipid levels with encoder status in CVD cohorts. Three studies were included in random effects meta-analysis (highlighted in orange and annotated on y-axis). The changes in HDL-C, LDL-C, total cholesterol (TC) level (mmol/L) and triglycerides (log TG, log 10 mmol/L) between encoders and non-encoders are presented for each study by the center of the square (95% confidence interval presented by respective horizontal black lines). The meta-analysis combined result is presented by blue diamonds with point estimate presented by vertical diamond points and dashed line, while horizontal points of the diamond represent the 95% CI. Solid black line represents null effect. Studies on the right from this line (i.e. positive values on the x axis) have a higher level of serum lipids in encoders compared to non-encoders; studies on the left (i.e. negative values on the x axis) have lower levels of serum lipids in encoders compared to non-encoders. In a meta-analysis of three studies we observed 0.14 mmol/L lower level of TC in non-encoders compared to encoders (95% CI: −0.27, −0.02) and 0.056 units for TG on log 10 scale lower levels of TG in non-encoders compared to encoders (95% CI: −0.083, −0.028). These differences were consistent among study participants with and without CVD in all three studies. Full results are presented in Table 13.
Figure 6:
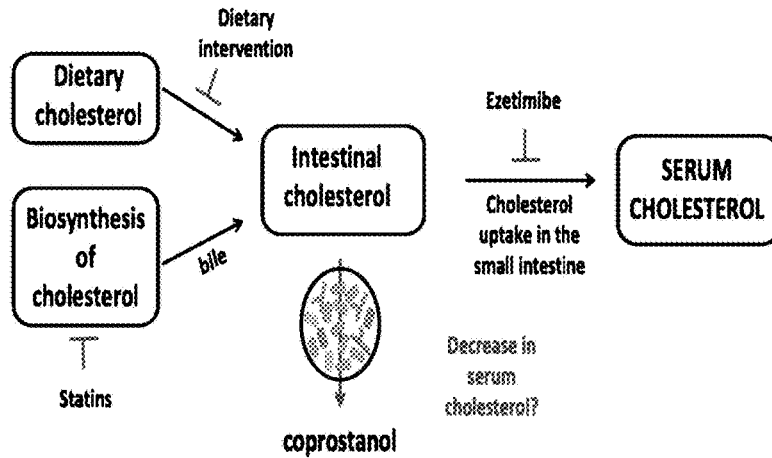
FIG. 6. A model for the factors influencing serum and intestinal cholesterol levels in humans. Intestinal cholesterol levels are influenced by both dietary and host-derived cholesterol. Intervention by changes in diet or use of statins both affect levels of intestinal cholesterol, while the use of ezetimibe blocks intestinal uptake of intestinal cholesterol. Gut microbial metabolism of cholesterol may serve to decrease reduce cholesterol absorption in the intestine, resulting in lower serum cholesterol levels.

The methods, systems, and tools provided herein may be designed for use with Class 1 CRISPR proteins. In certain example embodiments, the Class 1 system may be Type I, Type III or Type IV Cas proteins as described in Makarova et al. "Evolutionary classification of CRISPR-Cas systems: a burst of class 2 and derived variants" Nature Reviews Microbiology, 18:67-81 (February 2020), incorporated in its entirety herein by reference, and particularly as described in FIG. 1, p. 326. The Class 1 systems typically use a multi-protein effector complex, which can, in some embodiments, include ancillary proteins, such as one or more proteins in a complex referred to as a CRISPR-associated complex for antiviral defense (Cascade), one or more adaptation proteins (e.g. Cas1, Cas2, RNA nuclease), and/or one or more accessory proteins (e.g. Cas 4, DNA nuclease), CRISPR associated Rossman fold (CARF) domain containing proteins, and/or RNA transcriptase. Although Class 1 systems have limited sequence similarity, Class 1 system proteins can be identified by their similar architectures, including one or more Repeat Associated Mysterious Protein (RAMP) family subunits, e.g. Cas5, Cas6, Cas7. RAMP proteins are characterized by having one or more RNA recognition motif domains. Large subunits (for example cas8 or cas10) and small subunits (for example, cas11) are also typical of Class 1 systems. See, e.g., FIGS. 1 and 2. Koonin E V, Makarova K S. 2019 Origins and evolution of CRISPR-Cas systems. Phil. Trans. R. Soc. B 374: 20180087, DOI: 10.1098/rstb.2018.0087. In one aspect, Class 1 systems are characterized by the signature protein Cas3. The Cascade in particular Class 1 proteins can comprise a dedicated complex of multiple Cas proteins that binds pre-crRNA and recruits an additional Cas protein, for example Cas6 or Cas5, which is the nuclease directly responsible for processing pre-crRNA. In one aspect, the Type I CRISPR protein comprises an effector complex comprises one or more Cas5 subunits and two or more Cas7 subunits. Class 1 subtypes include Type I-A, I-B, I-C, I-U, I-D, I-E, and I-F, Type IV-A and IV-B, and Type III-A, III-D, III-C, and III-B. Class 1 systems also include CRISPR-Cas variants, including Type I-A, I-B, I-E, I-F and I-U variants, which can include variants carried by transposons and plasmids, including versions of subtype I-F encoded by a large family of Tn7-like transposon and smaller groups of Tn7-like transposons that encode similarly degraded subtype I-B systems. Peters et al., PNAS 114 (35) (2017); DOI: 10.1073/pnas.1709035114; see also, Makarova et al, the CRISPR Journal, v. 1, n5, FIG. 5.

Class 2 Systems

The compositions, systems, and methods described in greater detail elsewhere herein can be designed and adapted for use with Class 2 CRISPR-Cas systems. Thus, in some embodiments, the CRISPR-Cas system is a Class 2 CRISPR-Cas system. Class 2 systems are distinguished from Class 1 systems in that they have a single, large, multi-domain effector protein. In certain example embodiments, the Class 2 system can be a Type II, Type V, or Type VI system, which are described in Makarova et al. "Evolutionary classification of CRISPR-Cas systems: a burst of class 2 and derived variants" Nature Reviews Microbiology, 18:67-81 (February 2020), incorporated herein by reference. Each type of Class 2 system is further divided into subtypes. See Markova et al. 2020, particularly at Figure. 2. Class 2, Type II systems can be divided into 4 subtypes: II-A, II-B, II-C1, and II-C2. Class 2, Type V systems can be divided into 17 subtypes: V-A, V-B1, V-B2, V-C, V-D, V-E, V-F1, V-F1(V-U3), V-F2, V-F3, V-G, V-H, V-I, V-K (V-U5), V-U1, V-U2, and V-U4. Class 2, Type IV systems can be divided into 5 subtypes: VI-A, VI-B1, VI-B2, VI-C, and VI-D.

The distinguishing feature of these types is that their effector complexes consist of a single, large, multi-domain protein. Type V systems differ from Type II effectors (e.g., Cas9), which contain two nuclear domains that are each responsible for the cleavage of one strand of the target DNA, with the HNH nuclease inserted inside the Ruv-C like nuclease domain sequence. The Type V systems (e.g., Cas12) only contain a RuvC-like nuclease domain that cleaves both strands. Type VI (Cas13) are unrelated to the effectors of Type II and V systems and contain two HEPN domains and target RNA. Cas13 proteins also display collateral activity that is triggered by target recognition. Some Type V systems have also been found to possess this collateral activity with two single-stranded DNA in in vitro contexts.

In some embodiments, the Class 2 system is a Type II system. In some embodiments, the Type II CRISPR-Cas system is a II-A CRISPR-Cas system. In some embodiments, the Type II CRISPR-Cas system is a II-B CRISPR-Cas system. In some embodiments, the Type II CRISPR-Cas system is a II-C1 CRISPR-Cas system. In some embodiments, the Type II CRISPR-Cas system is a II-C2 CRISPR-Cas system. In some embodiments, the Type II system is a Cas9 system. In some embodiments, the Type II system includes a Cas9.

In some embodiments, the Class 2 system is a Type V system. In some embodiments, the Type V CRISPR-Cas system is a V-A CRISPR-Cas system. In some embodiments, the Type V CRISPR-Cas system is a V-B1 CRISPR-Cas system. In some embodiments, the Type V CRISPR-Cas system is a V-B2 CRISPR-Cas system. In some embodiments, the Type V CRISPR-Cas system is a V-C CRISPR-Cas system. In some embodiments, the Type V CRISPR-Cas system is a V-D CRISPR-Cas system. In some embodiments, the Type V CRISPR-Cas system is a V-E CRISPR-Cas system. In some embodiments, the Type V CRISPR-Cas system is a V-F1 CRISPR-Cas system. In some embodiments, the Type V CRISPR-Cas system is a V-F1 (V-U3) CRISPR-Cas system. In some embodiments, the Type V CRISPR-Cas system is a V-F2 CRISPR-Cas system. In some embodiments, the Type V CRISPR-Cas system is a V-F3 CRISPR-Cas system. In some embodiments, the Type V CRISPR-Cas system is a V-G CRISPR-Cas system. In some embodiments, the Type V CRISPR-Cas system is a V-H CRISPR-Cas system. In some embodiments, the Type V CRISPR-Cas system is a V-I CRISPR-Cas system. In some embodiments, the Type V CRISPR-Cas system is a V-K (V-U5) CRISPR-Cas system. In some embodiments, the Type V CRISPR-Cas system is a V-U1 CRISPR-Cas system. In some embodiments, the Type V CRISPR-Cas system is a V-U2 CRISPR-Cas system. In some embodiments, the Type V CRISPR-Cas system is a V-U4 CRISPR-Cas system. In some embodiments, the Type V CRISPR-Cas system includes a Cas12a (Cpf1), Cas12b (C2c1), Cas12c (C2c3), Cas12d (CasY), Cas12e (CasX), Cas14, and/or CasaD.

In some embodiments the Class 2 system is a Type VI system. In some embodiments, the Type VI CRISPR-Cas system is a VI-A CRISPR-Cas system. In some embodiments, the Type VI CRISPR-Cas system is a VI-B1 CRISPR-Cas system. In some embodiments, the Type VI CRISPR-Cas system is a VI-B2 CRISPR-Cas system. In some embodiments, the Type VI CRISPR-Cas system is a VI-C CRISPR-Cas system. In some embodiments, the Type VI CRISPR-Cas system is a VI-D CRISPR-Cas system. In some embodiments, the Type VI CRISPR-Cas system includes a Cas13a (C2c2), Cas13b (Group 29/30), Cas13c, and/or Cas13d.

Zinc Finger Nucleases

In some embodiments, the polynucleotide is modified using a Zinc Finger nuclease or system thereof. One type of programmable DNA-binding domain is provided by artificial zinc-finger (ZF) technology, which involves arrays of ZF modules to target new DNA-binding sites in the genome. Each finger module in a ZF array targets three DNA bases. A customized array of individual zinc finger domains is assembled into a ZF protein (ZFP).

ZFPs can comprise a functional domain. The first synthetic zinc finger nucleases (ZFNs) were developed by fusing a ZF protein to the catalytic domain of the Type IIS restriction enzyme FokI. (Kim, Y. G. et al., 1994, Chimeric restriction endonuclease, Proc. Natl. Acad. Sci. U.S.A. 91, 883-887; Kim, Y. G. et al., 1996, Hybrid restriction enzymes: zinc finger fusions to Fok I cleavage domain. Proc. Natl. Acad. Sci. U.S.A. 93, 1156-1160). Increased cleavage specificity can be attained with decreased off target activity by use of paired ZFN heterodimers, each targeting different nucleotide sequences separated by a short spacer. (Doyon, Y. et al., 2011, Enhancing zinc-finger-nuclease activity with improved obligate heterodimeric architectures. Nat. Methods 8, 74-79). ZFPs can also be designed as transcription activators and repressors and have been used to target many genes in a wide variety of organisms. Exemplary methods of genome editing using ZFNs can be found for example in U.S. Pat. Nos. 6,534,261, 6,607,882, 6,746,838, 6,794,136, 6,824,978, 6,866,997, 6,933,113, 6,979,539, 7,013,219, 7,030,215, 7,220,719, 7,241,573, 7,241,574, 7,585,849, 7,595,376, 6,903,185, and 6,479,626, all of which are specifically incorporated by reference.

Templates

In some embodiments, the composition for engineering cells comprise a template, e.g., a recombination template. A template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex. In an exemplary embodiments, such templates can be utilized for insertion of polynucleotides encoding COR homologs into species suitable for probiotics or other compositions for us in accordance with the invention disclosed herein. In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by a Cas protein mediated cleavage event. In an embodiment, the template nucleic acid may include a sequence that corresponds to both, a first site on the target sequence that is cleaved in a first Cas protein mediated event, and a second site on the target sequence that is cleaved in a second Cas protein mediated event.

In certain embodiments, the template nucleic acid can include a sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include a sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include a sequence which, when integrated, results in decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include a sequence which results in a change in sequence of 1, 2, 3, 4, 5, 6, 7, 8, 9, 10, 11, 12 or more nucleotides of the target sequence.

A template polynucleotide may be of any suitable length, such as about or more than about 10, 15, 20, 25, 50, 75, 100, 150, 200, 500, 1000, or more nucleotides in length. In an embodiment, the template nucleic acid may be 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 110+/−20, 120+/−20, 130+/−20, 140+/−20, 150+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the disclosure can be constructed using recombinant techniques (see, for example, Sambrook et al., 2001 and Ausubel et al., 1996).

In certain embodiments, a template nucleic acid for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Suzuki et al. describe in vivo genome editing via CRISPR/Cas9 mediated homology-independent targeted integration (2016, Nature 540:144-149).

TALE Nucleases

In some embodiments, a TALE nuclease or TALE nuclease system can be used to modify a polynucleotide. In some embodiments, the methods provided herein use isolated, non-naturally occurring, recombinant or engineered DNA binding proteins that comprise TALE monomers or TALE monomers or half monomers as a part of their organizational structure that enable the targeting of nucleic acid sequences with improved efficiency and expanded specificity.

Naturally occurring TALEs or "wild type TALEs" are nucleic acid binding proteins secreted by numerous species of proteobacteria. TALE polypeptides contain a nucleic acid binding domain composed of tandem repeats of highly conserved monomer polypeptides that are predominantly 33, 34 or 35 amino acids in length and that differ from each other mainly in amino acid positions 12 and 13. In advantageous embodiments the nucleic acid is DNA. As used herein, the term "polypeptide monomers", "TALE monomers" or "monomers" will be used to refer to the highly conserved repetitive polypeptide sequences within the TALE nucleic acid binding domain and the term "repeat variable di-residues" or "RVD" will be used to refer to the highly variable amino acids at positions 12 and 13 of the polypeptide monomers. As provided throughout the disclosure, the amino acid residues of the RVD are depicted using the IUPAC single letter code for amino acids. A general representation of a TALE monomer which is comprised within the DNA binding domain is $X_{1-11}$-$(X_{12}X_{13})$-$X_{14-33}$ or 34 or 35, where the subscript indicates the amino acid position and X represents any amino acid. $X_{12}X_{13}$ indicate the RVDs. In some polypeptide monomers, the variable amino acid at position 13 is missing or absent and in such monomers, the RVD consists of a single amino acid. In such cases the RVD may be alternatively represented as X*, where X represents $X_{12}$ and (*) indicates that $X_{13}$ is absent. The DNA binding domain comprises several repeats of TALE monomers and this may be represented as $(X_{1-11}$-$(X_{12}X_{13})$-$X_{14-33}$ or $_{34}$ or $_{35})_z$, where in an advantageous embodiment, z is at least 5 to 40. In a further advantageous embodiment, z is at least 10 to 26.

The TALE monomers can have a nucleotide binding affinity that is determined by the identity of the amino acids in its RVD. For example, polypeptide monomers with an RVD of NI can preferentially bind to adenine (A), monomers with an RVD of NG can preferentially bind to thymine (T), monomers with an RVD of HD can preferentially bind to cytosine (C) and monomers with an RVD of NN can preferentially bind to both adenine (A) and guanine (G). In some embodiments, monomers with an RVD of IG can preferentially bind to T. Thus, the number and order of the polypeptide monomer repeats in the nucleic acid binding domain of a TALE determines its nucleic acid target specificity. In some embodiments, monomers with an RVD of NS can recognize all four base pairs and can bind to A, T, G or C. The structure and function of TALEs is further described in, for example, Moscou et al., Science 326:1501 (2009); Boch et al., Science 326:1509-1512 (2009); and Zhang et al., Nature Biotechnology 29:149-153 (2011).

Meganucleases

In some embodiments, a meganuclease or system thereof can be used to modify a polynucleotide. Meganucleases, which are endodeoxyribonucleases characterized by a large recognition site (double-stranded DNA sequences of 12 to 40 base pairs). Exemplary methods for using meganucleases can be found in U.S. Pat. Nos. 8,163,514, 8,133,697, 8,021,867, 8,119,361, 8,119,381, 8,124,369, and 8,129,134, which are specifically incorporated herein by reference.

RNAi

In certain embodiments, the genetic modifying agent is RNAi (e.g., shRNA). As used herein, "gene silencing" or "gene silenced" in reference to an activity of an RNAi molecule, for example a siRNA or miRNA refers to a decrease in the mRNA level in a cell for a target gene by at least about 5%, about 10%, about 20%, about 30%, about 40%, about 50%, about 60%, about 70%, about 80%, about 90%, about 95%, about 99%, about 100% of the mRNA level found in the cell without the presence of the miRNA or RNA interference molecule. In one preferred embodiment, the mRNA levels are decreased by at least about 70%, about 80%, about 90%, about 95%, about 99%, about 100%.

As used herein, the term "RNAi" refers to any type of interfering RNA, including but not limited to, siRNAi, shRNAi, endogenous microRNA and artificial microRNA. For instance, it includes sequences previously identified as siRNA, regardless of the mechanism of down-stream processing of the RNA (i.e. although siRNAs are believed to have a specific method of in vivo processing resulting in the cleavage of mRNA, such sequences can be incorporated into the vectors in the context of the flanking sequences described herein). The term "RNAi" can include both gene silencing RNAi molecules, and also RNAi effector molecules which activate the expression of a gene.

In particular embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends an guide molecule that responds to normal or pathological physiological conditions, including without limitation pH, hypoxia, O2 concentration, temperature, protein concentration, enzymatic concentration, lipid structure, light exposure, mechanical disruption (e.g. ultrasound waves), magnetic fields, electric fields, or electromagnetic radiation.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Cryptochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

The chemical or energy sensitive guide may undergo a conformational change upon induction by the binding of a chemical source or by the energy allowing it act as a guide and have the CRISPR-Cas system or complex function. The invention can involve applying the chemical source or energy so as to have the guide function and the CRISPR-Cas system or complex function; and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans;4/164/rs2), 2. FKBP-FRB based system inducible by rapamycin (or related chemicals based on rapamycin) (see, e.g., nature.com/nmeth/journal/v2/n6/full/nmeth763.html), 3. GID1-GAI based system inducible by Gibberellin (GA) (see, e.g., nature.com/nchembio/journal/ v8/n5/full/nchembio.922.html). A chemical inducible system can be an estrogen receptor (ER) based system inducible by 4-hydroxytamoxifen (4OHT) (see, e.g., pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system. Another inducible system is based on the design using Transient receptor potential (TRP) ion channel based system inducible by energy, heat or radio-wave (see, e.g., sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the CRISPR-Cas complex or system, and the binding will induce the change of sub-cellular localization of the polypeptide, leading to the entire polypeptide entering the nucleus of cells. Once inside the nucleus, the guide protein and the other components of the CRISPR-Cas complex will be active and modulating target gene expression in cells.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1 µs and 500 milliseconds, preferably between 1 µs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference the presence of an electric potential difference in the environment of a cell. Such an environment may be set up by way of static electricity, alternating current (AC), direct current (DC), etc, as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100 .mu.s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between IV/cm and 20V/cm, for a period of 100 milliseconds or more, preferably 15 minutes or more.

Ultrasound is advantageously administered at a power level of from about 0.05 W/cm2 to about 100 W/cm2. Diagnostic or therapeutic ultrasound may be used, or combinations thereof. As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz' (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm2 (FDA recommendation), although energy densities of up to 750 mW/cm2 have been used. In physiotherapy, ultrasound is typically used as an energy source in a range up to about 3 to 4 W/cm2 (WHO recommendation). In other therapeutic applications, higher intensities of ultrasound may be employed, for example, HIFU at 100 W/cm up to 1 kW/cm2 (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and Tran Huu Hue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm-2. Even more preferably, the exposure to an ultrasound energy source is at a power density of from about 1 to about 15 Wcm-2.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes. Advantageously, the target tissue is exposed to an ultrasound energy source at an acoustic power density of from about 0.05 Wcm-2 to about 10 Wcm-2 with a frequency ranging from about 0.015 to about 10 MHz (see WO 98/52609). However, alternatives are also possible, for example, exposure to an ultrasound energy source at an acoustic power density of above 100 Wcm-2, but for reduced periods of time, for example, 1000 Wcm-2 for periods in the millisecond range or less. Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm-2 or 1.25 Wcm-2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as but not limited to a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

In particular embodiments, the guide molecule is modified by a secondary structure to increase the specificity of the CRISPR-Cas system and the secondary structure can protect against exonuclease activity and allow for 5' additions to the guide sequence also referred to herein as a protected guide molecule.

Delivery

In embodiments, microbes provided herein comprise a bacterial strain suitable for use as a probiotic and/or for oral delivery. In embodiments, the engineered microbe is suitable for delivery to the gut, the lumen of the gastrointestinal tract, of a subject, by, for example, fecal microbiota transplant (FMT). In particular embodiments, the FMT may comprise microbes cultured from the stool of encoders. As used herein, encoders are subjects that encode enzymes with the catalytic capabilities needed to perform transformations on cholesterol or related molecules, in some embodiments, encoders have the capability of metabolizing cholesterol to coprosterol. Encoders may be identified by a reduced amount of cholesterol content in the stool, an increase in cholestenone, coprostanone and/or coprostanol in the stool relative to non-encoders.

Targeted delivery may use materials with particular properties, for example, enteric, colon-targeting, omniphobic, mucoadhesive, or mucus-penetrating properties. Microbes can be further engineered with tissue targeting properties.

The present disclosure also provides delivery systems for introducing exogenous perturbation construction herein to cells in an animal model, such as Cas animal model. A delivery system may comprise one or more delivery vehicles and/or cargos. Exemplary delivery systems and methods include those described in paragraphs [00117] to [00278] of Feng Zhang et al., (WO2016106236A1), and pages 1241-1251 and Table 1 of Lino C A et al., Delivering CRISPR: a review of the challenges and approaches, DRUG DELIVERY, 2018, VOL. 25, NO. 1, 1234-1257, which are incorporated by reference herein in their entireties.

The nucleic acids and/or polypeptides, can be introduced to cells by transduction by a viral or pseudoviral particle. Methods of packaging the cargos in viral particles can be accomplished using any suitable viral vector or vector systems. Such viral vector and vector systems are described in greater detail elsewhere herein. As used in this context herein "transduction" refers to the process by which foreign nucleic acids and/or proteins are introduced to a cell (prokaryote or eukaryote) by a viral or pseudo viral particle. After packaging in a viral particle or pseudo viral particle, the viral particles can be exposed to cells (e.g. in vitro, ex vivo, or in vivo) where the viral or pseudoviral particle infects the cell and delivers the cargo to the cell via transduction. Viral and pseudoviral particles can be optionally concentrated prior to exposure to target cells. In some embodiments, the virus titer of a composition containing viral and/or pseudoviral particles can be obtained and a specific titer be used to transduce cells.

Vectors and Vector Systems

Also provided herein are vectors that can contain one or more of the perturbation constructs or components thereof described herein, such as the two or more gRNAs, reporter gene and barcode. In certain embodiments, the vector can contain one or more polynucleotides encoding one or more elements of a perturbation construct described herein. The vectors can be useful in producing bacterial, fungal, yeast, plant cells, animal cells, and transgenic animals that can express one or more components of the perturbation construct described herein. Within the scope of this disclosure are vectors containing one or more of the polynucleotide sequences described herein. One or more of the polynucleotides that are part of the perturbation construct described herein can be included in a vector or vector system. The vectors and/or vector systems can be used, for example, to express one or more of the polynucleotides in a cell, such as a producer cell, to produce perturbation construct system containing virus particles described elsewhere herein. Other uses for the vectors and vector systems described herein are also within the scope of this disclosure. In general, and throughout this specification, the term "vector" refers to a tool that allows or facilitates the transfer of an entity from one environment to another. In some contexts which will be appreciated by those of ordinary skill in the art, "vector" can be a term of art to refer to a nucleic acid molecule capable of transporting another nucleic acid to which it has been linked. A vector can be a replicon, such as a plasmid, phage, or cosmid, into which another DNA segment may be inserted so as to bring about the replication of the inserted segment. Generally, a vector is capable of replication when associated with the proper control elements.

Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can be composed of a nucleic acid (e.g. a polynucleotide) of the invention in a form suitable for expression of the nucleic acid in a host cell, which means that the recombinant expression vectors include one or more regulatory elements, which can be selected on the basis of the host cells to be used for expression, that is operatively-linked to the nucleic acid sequence to be expressed. Within a recombinant expression vector, "operably linked" and "operatively-linked" are used interchangeably herein and further defined elsewhere herein. In the context of a vector, the term "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells. These and other embodiments of the vectors and vector systems are described elsewhere herein.

In some embodiments, the vector can be a bicistronic vector. In some embodiments, a bicistronic vector can be used for one or more elements of the perturbation construct described herein. In some embodiments, expression of elements of the perturbation construct described herein can be driven by a ubiquitous promoter, constitutive, cell-specific promoter, inducible promoter or any permissible combination thereof. In some embodiments, expression of elements of the perturbation construct described herein can be driven by a cell-specific and/or inducible promoter. Where the element of the perturbation construct system is an RNA, its expression can be driven by a Pol III promoter, such as a U6 promoter. In some embodiments, the reporter gene expression is driven by a pol II promoter, such as EF1a, beta actin, CAG, and the like.

Cell-Based Vector Amplification and Expression

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). The vectors can be viral-based or non-viral based. In some embodiments, a prokaryote is used to amplify copies of a vector and express one or more nucleic acids, such as to provide a source of one or more proteins for delivery to a host cell or host organism.

Vectors can be designed for expression of one or more elements of the perturbation construct described herein (e.g. nucleic acids, transcripts, proteins, enzymes, and combinations thereof) in a suitable host cell. In some embodiments, the suitable host cell is a prokaryotic cell. Suitable host cells include, but are not limited to, bacterial cells, yeast cells, insect cells, and mammalian cells. In some embodiments, the suitable host cell is a eukaryotic cell.

In some embodiments, the suitable host cell is a suitable bacterial cell. Suitable bacterial cells include, but are not limited to bacterial cells from the bacteria of the species *Escherichia coli*. Many suitable strains of *E. coli* are known in the art for expression of vectors. These include, but are not limited to Pir1, Stbl2, Stbl3, Stbl4, TOP10, XL1 Blue, and XL10 Gold. In some embodiments, the host cell is a suitable insect cell. Suitable insect cells include those from *Spodoptera frugiperda*. Suitable strains of *S. frugiperda* cells include, but are not limited to Sf9 and Sf21. In some embodiments, the host cell is a suitable yeast cell. In some embodiments, the yeast cell can be from *Saccharomyces cerevisiae*. In some embodiments, the host cell is a suitable mammalian cell. Many types of mammalian cells have been developed to express vectors. Suitable mammalian cells include, but are not limited to, HEK293, Chinese Hamster Ovary Cells (CHOs), HeLa, U2OS, A549, HT1080, CAD, P19, NIH 3T3, L929, N2a, MCF-7, Y79, SO-Rb50, HepG G2, DIKX-X11, J558L, Baby hamster kidney cells (BHK), and chicken embryo fibroblasts (CEFs). Suitable host cells are discussed further in Goeddel, GENE EXPRESSION TECHNOLOGY: METHODS IN ENZYMOLOGY 185, Academic Press, San Diego, Calif. (1990).

In some embodiments, the vector is a baculovirus vector or expression vector and can be suitable for expression of polynucleotides and/or proteins in insect cells. In some embodiments, the suitable host cell is an insect cell. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39). rAAV (recombinant Adeno-associated viral) vectors are preferably produced in insect cells, e.g., *Spodoptera frugiperda* Sf9 insect cells, grown in serum-free suspension culture. Serum-free insect cells can be purchased from commercial vendors, e.g., Sigma Aldrich (EX-CELL 405).

In some embodiments, the vector is a mammalian expression vector. In some embodiments, the mammalian expression vector is capable of expressing one or more polynucleotides and/or polypeptides in a mammalian cell. Examples of mammalian expression vectors include, but are not limited to, pCDM8 (Seed, 1987. Nature 329: 840) and pMT2PC (Kaufman, et al., 1987. EMBO J. 6: 187-195). The mammalian expression vector can include one or more suitable regulatory elements capable of controlling expression of the one or more polynucleotides and/or proteins in the mammalian cell. For example, commonly used promoters are derived from polyoma, adenovirus 2, cytomegalovirus, simian virus 40, and others disclosed herein and known in the art. More detail on suitable regulatory elements are described elsewhere herein.

For other suitable expression vectors and vector systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the α-fetoprotein promoter (Camper and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments can utilize viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element can be operably linked to one or more elements of a perturbation construct described herein so as to drive expression of the one or more elements of the perturbation construct described herein.

In some embodiments, the vector can be a fusion vector or fusion expression vector. In some embodiments, fusion vectors add a number of amino acids to a protein encoded therein, such as to the amino terminus, carboxy terminus, or both of a recombinant protein. Such fusion vectors can serve one or more purposes, such as: (i) to increase expression of recombinant protein; (ii) to increase the solubility of the recombinant protein; and (iii) to aid in the purification of the recombinant protein by acting as a ligand in affinity purification. In some embodiments, expression of polynucleotides (such as non-coding polynucleotides) and proteins in prokaryotes can be carried out in *Escherichia coli* with vectors containing constitutive or inducible promoters directing the expression of either fusion or non-fusion polynucleotides and/or proteins. In some embodiments, the fusion expression vector can include a proteolytic cleavage site, which can be introduced at the junction of the fusion vector backbone or other fusion moiety and the recombinant polynucleotide or protein to enable separation of the recombinant polynucleotide or protein from the fusion vector backbone or other fusion moiety subsequent to purification of the fusion polynucleotide or protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, one or more vectors driving expression of one or more elements of a perturbation construct described herein are introduced into a host cell, such as in an animal model (e.g. a Cas animal model) such that expression of the elements of the engineered delivery system described herein direct formation a CRISPR-Cas complex at one or more target sites. For example, a CRISPR-Cas effector protein described herein can be provided in the host cell and a nucleic acid component (e.g., a guide polynucleotide) can be operably linked to a regulatory elements on separate vectors. Different or all elements of perturbation construct described herein can be delivered to an animal, plant, microorganism or cell thereof to produce an animal (e.g., a mammal, reptile, avian, etc.), plant, microorganism or cell thereof that constitutively, inducibly, or conditionally expresses all or different elements of the perturbation construct described herein. As previously described the host cell can express or be capable of expressing a Cas protein, such that when gRNAs present in the perturbation construct are expressed in the same host cell, a CRISPR-Cas system is generated and genetic perturbations can be introduced in that cell.

In some embodiments, two or more of the elements expressed from the same or different regulatory element(s), can be combined in a single vector, with one or more additional vectors providing any components of the system not included in the first vector. perturbation construct polynucleotides that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction.

Vector Features

The vectors can include additional features that can confer one or more functionalities to the vector, the polynucleotide to be delivered, a virus particle produced there from, or polypeptide expressed thereof. Such features include, but are not limited to, regulatory elements, selectable markers, molecular identifiers (e.g. molecular barcodes), stabilizing elements, and the like. It will be appreciated by those skilled in the art that the design of the expression vector and additional features included can depend on such factors as the choice of the host cell to be transformed, the level of expression desired, etc.

Regulatory Elements

In certain embodiments, the polynucleotides and/or vectors thereof described herein (such as the perturbation construct of the present invention) can include one or more regulatory elements that can be operatively linked to the polynucleotide. The term "regulatory element" is intended to include promoters, enhancers, internal ribosomal entry sites (IRES), other expression control elements (e.g., transcription termination signals, such as polyadenylation signals and poly-U sequences) and cellular localization signals (e.g. nuclear localization signals). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter can direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6, 7SK, and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) (see, e.g., Boshart et al, Cell, 41:521-530 (1985)), the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). Specific configurations of the gRNAs, reporter gene and pol II and pol III promoters in the context of the present invention are described in greater detail elsewhere herein.

In some embodiments, the regulatory sequence can be a regulatory sequence described in U.S. Pat. No. 7,776,321, U.S. Pat. Pub. No. 2011/0027239, and International Patent Publication No. WO 2011/028929, the contents of which are incorporated by reference herein in their entirety. In some embodiments, the vector can contain a minimal promoter. In some embodiments, the minimal promoter is the Mecp2 promoter, tRNA promoter, or U6. In a further embodiment, the minimal promoter is tissue specific. In some embodiments, the length of the vector polynucleotide the minimal promoters and polynucleotide sequences is less than 4.4 Kb.

To express a polynucleotide, the vector can include one or more transcriptional and/or translational initiation regulatory sequences, e.g. promoters, that direct the transcription of the gene and/or translation of the encoded protein in a cell. In some embodiments a constitutive promoter may be employed. Suitable constitutive promoters for mammalian cells are generally known in the art and include, but are not limited to SV40, CAG, CMV, EF-1α, β-actin, RSV, and PGK. Suitable constitutive promoters for bacterial cells, yeast cells, and fungal cells are generally known in the art, such as a T-7 promoter for bacterial expression and an alcohol dehydrogenase promoter for expression in yeast.

In some embodiments, the regulatory element can be a regulated promoter. "Regulated promoter" refers to promoters that direct gene expression not constitutively, but in a temporally- and/or spatially-regulated manner, and includes tissue-specific, tissue-preferred and inducible promoters. Regulated promoters include conditional promoters and inducible promoters. In some embodiments, conditional promoters can be employed to direct expression of a polynucleotide in a specific cell type, under certain environmental conditions, and/or during a specific state of development. Suitable tissue specific promoters can include, but are not limited to, liver specific promoters (e.g. APOA2, SERPIN A1 (hAAT), CYP3A4, and MIR122), pancreatic cell promoters (e.g. INS, IRS2, Pdx1, Alx3, Ppy), cardiac specific promoters (e.g. Myh6 (alpha MHC), MYL2 (MLC-2v), TNI3 (cTn1), NPPA (ANF), Slc8a1 (Ncx1)), central nervous system cell promoters (SYN1, GFAP, INA, NES, MOBP, MBP, TH, FOXA2 (HNF3 beta)), skin cell specific promoters (e.g. FLG, K14, TGM3), immune cell specific promoters, (e.g. ITGAM, CD43 promoter, CD14 promoter, CD45 promoter, CD68 promoter), urogenital cell specific promoters (e.g. Pbsn, Upk2, Sbp, Ferl14), endothelial cell specific promoters (e.g. ENG), pluripotent and embryonic germ layer cell specific promoters (e.g. Oct4, NANOG, Synthetic Oct4, T brachyury, NES, SOX17, FOXA2, MIR122), and muscle cell specific promoter (e.g. Desmin). Other tissue and/or cell specific promoters are generally known in the art and are within the scope of this disclosure.

Inducible/conditional promoters can be positively inducible/conditional promoters (e.g. a promoter that activates transcription of the polynucleotide upon appropriate interaction with an activated activator, or an inducer (compound, environmental condition, or other stimulus)) or a negative/conditional inducible promoter (e.g. a promoter that is repressed (e.g. bound by a repressor) until the repressor condition of the promotor is removed (e.g. inducer binds a repressor bound to the promoter stimulating release of the promoter by the repressor or removal of a chemical repressor from the promoter environment)). The inducer can be a compound, environmental condition, or other stimulus. Thus, inducible/conditional promoters can be responsive to any suitable stimuli such as chemical, biological, or other molecular agents, temperature, light, and/or pH. Suitable inducible/conditional promoters include, but are not limited to, Tet-On, Tet-Off, Lac promoter, pBad, AlcA, LexA, Hsp70 promoter, Hsp90 promoter, pDawn, XVE/OlexA, GVG, and pOp/LhGR.

Examples of promoters that are inducible and that can allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome), such as a Light Inducible Transcriptional Effector (LITE) that direct changes in transcriptional activity in a sequence-specific manner. The components of a light inducible system may include one or more elements of the CRISPR-Cas system described herein, a light-responsive cytochrome heterodimer (e.g. from *Arabidopsis thaliana*), and a transcriptional activation/repression domain. In some embodiments, the vector can include one or more of the inducible DNA binding proteins provided in International Patent Publication No. WO 2014/018423 and US Patent Publication Nos., 2015/0291966, 2017/0166903, 2019/0203212, which describe e.g. embodiments of inducible DNA binding proteins and methods of use and can be adapted for use with the present invention.

In some embodiments, transient or inducible expression can be achieved by including, for example, chemical-regulated promoters, i.e. whereby the application of an exogenous chemical induces gene expression. Modulation of gene expression can also be obtained by including a chemical-repressible promoter, where application of the chemical represses gene expression. Chemical-inducible promoters include, but are not limited to, the maize ln 2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

In some embodiments, the polynucleotide, vector or system thereof can include one or more elements capable of translocating and/or expressing a one or more elements of a perturbation construct described herein to/in a specific cell component or organelle. Such organelles can include, but are not limited to, nucleus, ribosome, endoplasmic reticulum, Golgi apparatus, chloroplast, mitochondria, vacuole, lysosome, cytoskeleton, plasma membrane, cell wall, peroxisome, centrioles, etc. Such regulatory elements can include, but are not limited to, nuclear localization signals (examples of which are described in greater detail elsewhere herein), any such as those that are annotated in the LocSigDB database (see e.g. http://genome.unmc.edu/LocSigDB/and Negi et al., 2015. Database. 2015: bav003; doi: 10.1093/database/bav003), nuclear export signals, endoplasmic reticulum localization/retention signals (see e.g. Liu et al. 2007 Mol. Biol. Cell. 18(3):1073-1082 and Gorleku et al., 2011. J. Biol. Chem. 286:39573-39584), mitochondria (see e.g. Cell Reports. 22:2818-2826, particularly at FIG. 2; Doyle et al. 2013. PLoS ONE 8, e67938; Funes et al. 2002. J. Biol. Chem. 277:6051-6058; Matouschek et al. 1997. PNAS USA 85:2091-2095; Oca-Cossio et al., 2003. 165: 707-720; Waltner et al., 1996. J. Biol. Chem. 271:21226-21230; Wilcox et al., 2005. PNAS USA 102:15435-15440; Galanis et al., 1991. FEBS Lett 282:425-430, peroxisome (e.g. (S/A/C)-(K/R/H)-(L/A), SLK, (R/K)-(L/V/I)-XXXXX-(H/Q)-(L/A/F). Suitable protein targeting motifs can also be designed or identified using any suitable database or prediction tool, including but not limited to Minimotif Miner (http:minimotifminer.org, http://mitominer.mrc-mbu.cam.ac.uk/release-4.0/embodiment.do?name=Protein %20MTS), LocDB (see above), PTSs predictor ( ), TargetP-2.0 (http://www.cbs.dtu.dk/services/TargetP/), ChloroP (http://www.cbs.dtu.dk/services/ChloroP/); NetNES (http://www.cbs.dtu.dk/services/NetNES/), Predotar (https://urgi.versailles.inra.fr/predotar/), and SignalP (http://www.cbs.dtu.dk/services/SignalP/).

Reporter Genes, Selectable Markers, and Tags

In some embodiments, one or more of the gRNAs and/or barcodes of the perturbation construct described herein is operably linked, fused to, or otherwise modified to include a polynucleotide that encodes or is a selectable marker or tag, which can be a polynucleotide or polypeptide. Such configurations are described in greater detail elsewhere herein.

It will be appreciated that the polynucleotide encoding such selectable markers or tags can be incorporated into a polynucleotide encoding one or more components of the CRISPR-Cas system described herein in an appropriate manner to allow expression of the selectable marker or tag. Such techniques and methods are described elsewhere herein and will be instantly appreciated by one of ordinary skill in the art in view of this disclosure. Many such selectable markers and tags are generally known in the art and are intended to be within the scope of this disclosure.

Reporter genes/proteins, selectable markers and tags include, but are not limited to, affinity tags, such as chitin binding protein (CBP), maltose binding protein (MBP), glutathione-S-transferase (GST), poly(His) tag; solubilization tags such as thioredoxin (TRX) and poly(NANP), MBP, and GST; chromatography tags such as those consisting of polyanionic amino acids, such as FLAG-tag; epitope tags such as V5-tag, Myc-tag, HA-tag and NE-tag; protein tags that can allow specific enzymatic modification (such as biotinylation by biotin ligase) or chemical modification (such as reaction with FlAsH-EDT2 for fluorescence imaging), DNA and/or RNA segments that contain restriction enzyme or other enzyme cleavage sites; DNA segments that encode products that provide resistance against otherwise toxic compounds including antibiotics, such as, spectinomycin, ampicillin, kanamycin, tetracycline, Basta, neomycin phosphotransferase II (NEO), hygromycin phosphotransferase (HPT)) and the like; DNA and/or RNA segments that encode products that are otherwise lacking in the recipient cell (e.g., tRNA genes, auxotrophic markers); DNA and/or RNA segments that encode products which can be readily identified (e.g., phenotypic markers such as β-galactosidase, GUS; optically active proteins (e.g. fluorescent proteins such as a green fluorescent protein (GFP), cyan (CFP), yellow (YFP), red (RFP), blue (BFP) luciferase, and cell surface proteins); polynucleotides that can generate one or more new primer sites for PCR (e.g., the juxtaposition of two DNA sequences not previously juxtaposed), DNA sequences not acted upon or acted upon by a restriction endonuclease or other DNA modifying enzyme, chemical, etc.; epitope tags (e.g. GFP, FLAG- and His-tags), and, DNA sequences that make a molecular barcode or unique molecular identifier (UMI), DNA sequences required for a specific modification (e.g., methylation) that allows its identification. Other suitable markers will be appreciated by those of skill in the art.

In some embodiments, the reporter gene can be a gene coding for a cluster of differentiation (CD) molecule or CD molecules. The CD molecules that can be used as a reporter herein include, but are not limited to, CD3, CD4, CD8, CD19, CD20, CD22, CD27, CD29, CD30, CD33, CD34, CD44, CD45, CD47, CD48, CD58, CD66, CD70, CD79, CD80, CD82, CD86, CD101, and CD156. In some embodiments, the reporter gene can be a gene coding for a cell surface receptor that include, but are not limited to, EGFR, FGFR, HER2, and HER3. In certain example embodiments, the reporter gene encodes a cell surface molecules selected from the group of: CD3, CD4, CD19, CD20, CD22, CD34, CD45, CD80, a cell surface receptor, a cluster differentiation (CD) molecule, or any combination thereof.

Reporter genes, selectable markers, and tags can be operably linked to one or more components of the perturbation construct described herein via suitable linker, such as a glycine or glycine serine linkers, which are generally known in the art. Other suitable linkers are described elsewhere herein and generally known in the art.

The vector or vector system can include one or more polynucleotides encoding one or more targeting moieties. In some embodiments, the targeting moiety encoding polynucleotides can be included in the vector or vector system, such as a viral vector system, such that they are expressed within and/or on the virus particle(s) produced such that the virus particles can be targeted to specific cells, tissues, organs, etc. In some embodiments, the targeting moiety encoding polynucleotides can be included in the vector or vector system such that the perturbation construct described herein and/or products expressed therefrom include the targeting moiety and can be targeted to specific cells, tissues, organs, etc. In some embodiments, such as non-viral carriers, the targeting moiety can be attached to the carrier (e.g. polymer, lipid, inorganic molecule etc.) and can be capable of targeting the carrier and any attached or associated perturbation construct or component thereof described herein to specific cells, tissues, organs, etc.

Codon Optimization of Vector Polynucleotides

As described elsewhere herein, the polynucleotide encoding one or more embodiments of the perturbation construct described herein can be codon optimized. In some embodiments, one or more polynucleotides contained in a vector ("vector polynucleotides") described herein that are in addition to an optionally codon optimized polynucleotide encoding embodiments of the perturbation construct described herein can be codon optimized. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen, Jacobus, Pa.), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at http://www.yeastgenome.org/community/codon_usage.shtml, or *Codon selection in yeast*, Bennetzen and Hall, J Biol Chem. 1982 Mar. 25; 257(6):3026-31. As to codon usage in plants including algae, reference is made to *Codon usage in higher plants, green algae, and cyanobacteria*, Campbell and Gowri, Plant Physiol. 1990 January; 92(1): 1-11.; as well as *Codon usage in plant genes*, Murray et al, Nucleic Acids Res. 1989 Jan. 25; 17(2):477-98; or *Selection on the codon bias of chloroplast and cyanelle genes in different plant and algal lineages*, Morton B R, J Mol Evol. 1998 April; 46(4):449-59.

The vector polynucleotide can be codon optimized for expression in a specific cell-type, tissue type, organ type, and/or subject type. In some embodiments, a codon optimized sequence is a sequence optimized for expression in a eukaryote, e.g., humans (i.e. being optimized for expression in a human or human cell), or for another eukaryote, such as another animal (e.g. a mammal or avian) as is described elsewhere herein. Such codon optimized sequences are within the ambit of the ordinary skilled artisan in view of the description herein. In some embodiments, the polynucleotide is codon optimized for a specific cell type. Such cell types can include, but are not limited to, epithelial cells (including skin cells, cells lining the gastrointestinal tract, cells lining other hollow organs), nerve cells (nerves, brain cells, spinal column cells, nerve support cells (e.g. astrocytes, glial cells, Schwann cells etc.), muscle cells (e.g. cardiac muscle, smooth muscle cells, and skeletal muscle cells), connective tissue cells (fat and other soft tissue padding cells, bone cells, tendon cells, cartilage cells), blood cells, stem cells and other progenitor cells, immune system cells, germ cells, and combinations thereof. Such codon optimized sequences are within the ambit of the ordinary skilled artisan in view of the description herein. In some embodiments, the polynucleotide is codon optimized for a specific tissue type. Such tissue types can include, but are not limited to, muscle tissue, connective tissue, connective tissue, nervous tissue, and epithelial tissue. Such codon optimized sequences are within the ambit of the ordinary skilled artisan in view of the description herein. In some embodiments, the polynucleotide is codon optimized for a specific organ. Such organs include, but are not limited to, muscles, skin, intestines, liver, spleen, brain, lungs, stomach, heart, kidneys, gallbladder, pancreas, bladder, thyroid, bone, blood vessels, blood, and combinations thereof. Such codon optimized sequences are within the ambit of the ordinary skilled artisan in view of the description herein.

In some embodiments, a vector polynucleotide is codon optimized for expression in particular cells, such as prokaryotic or eukaryotic cells. The eukaryotic cells may be those of or derived from a particular organism, such as a plant or a mammal, including but not limited to human, or non-human eukaryote or animal or mammal as discussed herein, e.g., mouse, rat, rabbit, dog, livestock, or non-human mammal or primate.

Vector Construction

The vectors described herein can be constructed using any suitable process or technique. In some embodiments, one or more suitable recombination and/or cloning methods or techniques can be used to the vector(s) described herein. Suitable recombination and/or cloning techniques and/or methods can include, but not limited to, those described in U.S. Patent Publication No. US 2004/0171156 A1. Other suitable methods and techniques are described elsewhere herein.

Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989). Any of the techniques and/or methods can be used and/or adapted for constructing an AAV or other vector described herein. nAAV vectors are discussed elsewhere herein.

In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide polynucleotides are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide s polynucleotides. In some embodiments, about or more than about 1, 2, 3, 4, 5, 6, 7, 8, 9, 10, or more such guide-polynucleotide-containing vectors may be provided, and optionally delivered to a cell.

Delivery vehicles, vectors, particles, nanoparticles, formulations and components thereof for expression of one or more elements of a CRISPR-Cas system described herein are as used in the foregoing documents, such as International Patent Publication No. WO 2014/093622 (PCT/US2013/074667) and are discussed in greater detail herein.

Viral Vectors

In some embodiments, the vector is a viral vector. The term of art "viral vector" and as used herein in this context refers to polynucleotide based vectors that contain one or more elements from or based upon one or more elements of a virus that can be capable of expressing and packaging a polynucleotide, such as a perturbation construct of the present invention, into a virus particle and producing said virus particle when used alone or with one or more other viral vectors (such as in a viral vector system). Viral vectors and systems thereof can be used for producing viral particles for delivery of and/or expression of one or more components of the perturbation construct described herein. The viral vector can be part of a viral vector system involving multiple vectors. In some embodiments, systems incorporating multiple viral vectors can increase the safety of these systems. Suitable viral vectors can include retroviral-based vectors, lentiviral-based vectors, adenoviral-based vectors, adeno associated vectors, helper-dependent adenoviral (HdAd) vectors, hybrid adenoviral vectors, herpes simplex virus-based vectors, poxvirus-based vectors, and Epstein-Barr virus-based vectors. Other embodiments of viral vectors and viral particles produce therefrom are described elsewhere herein. In some embodiments, the viral vectors are configured to produce replication incompetent viral particles for improved safety of these systems.

In certain embodiments, the virus structural component, which can be encoded by one or more polynucleotides in a viral vector or vector system, comprises one or more capsid proteins including an entire capsid. In certain embodiments, such as wherein a viral capsid comprises multiple copies of different proteins, the delivery system can provide one or more of the same protein or a mixture of such proteins. For example, AAV comprises 3 capsid proteins, VP1, VP2, and VP3, thus delivery systems of the invention can comprise one or more of VP1, and/or one or more of VP2, and/or one or more of VP3. Accordingly, the present invention is applicable to a virus within the family Adenoviridae, such as Atadenovirus, e.g., Ovine atadenovirus D, Aviadenovirus, e.g., Fowl aviadenovirus A, Ichtadenovirus, e.g., Sturgeon ichtadenovirus A, Mastadenovirus (which includes adenoviruses such as all human adenoviruses), e.g., Human mastadenovirus C, and Siadenovirus, e.g., Frog siadenovirus A. Thus, a virus of within the family Adenoviridae is contemplated as within the invention with discussion herein as to adenovirus applicable to other family members. Target-specific AAV capsid variants can be used or selected. Non-limiting examples include capsid variants selected to bind to chronic myelogenous leukemia cells, human CD34 PBPC cells, breast cancer cells, cells of lung, heart, dermal fibroblasts, melanoma cells, stem cell, glioblastoma cells, coronary artery endothelial cells and keratinocytes. See, e.g., Buning et al, 2015, Current Opinion in Pharmacology 24, 94-104. From teachings herein and knowledge in the art as to modifications of adenovirus (see, e.g., U.S. Pat. Nos. 9,410,129, 7,344,872, 7,256,036, 6,911,199, 6,740,525; Matthews, "Capsid-Incorporation of Antigens into Adenovirus Capsid Proteins for a Vaccine Approach," Mol Pharm, 8(1): 3-11 (2011)), as well as regarding modifications of AAV, the skilled person can readily obtain a modified adenovirus that has a large payload protein or a CRISPR-protein, despite that heretofore it was not expected that such a large protein could be provided on an adenovirus. And as to the viruses related to adenovirus mentioned herein, as well as to the viruses related to AAV mentioned elsewhere herein, the teachings herein as to modifying adenovirus and AAV, respectively, can be applied to those viruses without undue experimentation from this disclosure and the knowledge in the art.

In some embodiments, the viral vector is configured such that when the cargo is packaged the cargo(s) (e.g. one or more components of the perturbation construct including but not limited to the two or more gRNAs, is/are external to the capsid or virus particle. In the sense that it is not inside the capsid (enveloped or encompassed with the capsid), but is externally exposed so that it can contact the target genomic DNA. In some embodiments, the viral vector is configured such that all the cargo(s) are contained within the capsid after packaging.

Retroviral and Lentiviral Vectors

Retroviral vectors can be composed of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Suitable retroviral vectors for the perturbation construct described herein can include those based upon murine leukemia virus (MuLV), gibbon ape leukemia virus (GaLV), Simian immunodeficiency virus (SIV), human immunodeficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). Selection of a retroviral gene transfer system may therefore depend on the target tissue.

The tropism of a retrovirus can be altered by incorporating foreign envelope proteins, expanding the potential target population of target cells. Lentiviral vectors are retroviral vectors that are able to transduce or infect non-dividing cells and are described in greater detail elsewhere herein. A retrovirus can also be engineered to allow for conditional expression of the inserted transgene, such that only certain cell types are infected by the lentivirus.

Lentiviruses are complex retroviruses that have the ability to infect and express their genes in both mitotic and post-mitotic cells. Advantages of using a lentiviral approach can include the ability to transduce or infect non-dividing cells and their ability to typically produce high viral titers, which can increase efficiency or efficacy of production and delivery. Suitable lentiviral vectors include, but are not limited to, human immunodeficiency virus (HIV)-based lentiviral vectors, feline immunodeficiency virus (FIV)-based lentiviral vectors, simian immunodeficiency virus (SIV)-based lentiviral vectors, Moloney Murine Leukaemia Virus (Mo-MLV), Visna.maedi virus (VMV)-based lentiviral vector, carpine arthritis-encephalitis virus (CAEV)-based lentiviral vector, bovine immune deficiency virus (BIV)-based lentiviral vector, and Equine infectious anemia (EIAV)-based lentiviral vector. In some embodiments, an HIV-based lentiviral vector system can be used. In some embodiments, a FIV-based lentiviral vector system can be used.

In some embodiments, the lentiviral vector is an EIAV-based lentiviral vector or vector system. EIAV vectors have been used to mediate expression, packaging, and/or delivery in other contexts, such as for ocular gene therapy (see, e.g., Balagaan, J Gene Med 2006; 8: 275-285). In another embodiment, RetinoStat®, (see, e.g., Binley et al., HUMAN GENE THERAPY 23:980-991 (September 2012)), which describes RetinoStat®, an equine infectious anemia virus-based lentiviral gene therapy vector that expresses angiostatic proteins endostatin and angiostatin that is delivered via a subretinal injection for the treatment of the wet form of age-related macular degeneration. Any of these vectors described in these publications can be modified for the elements of the perturbation construct described herein.

In some embodiments, the lentiviral vector or vector system thereof can be a first-generation lentiviral vector or vector system thereof. First-generation lentiviral vectors can contain a large portion of the lentivirus genome, including the gag and pol genes, other additional viral proteins (e.g. VSV-G) and other accessory genes (e.g. vif, vprm vpu, nef, and combinations thereof), regulatory genes (e.g. tat and/or rev) as well as the gene of interest between the LTRs. First generation lentiviral vectors can result in the production of virus particles that can be capable of replication in vivo, which may not be appropriate for some instances or applications.

In some embodiments, the lentiviral vector or vector system thereof can be a second-generation lentiviral vector or vector system thereof. Second-generation lentiviral vectors do not contain one or more accessory virulence factors and do not contain all components necessary for virus particle production on the same lentiviral vector. This can result in the production of a replication-incompetent virus particle and thus increase the safety of these systems over first-generation lentiviral vectors. In some embodiments, the second-generation vector lacks one or more accessory virulence factors (e.g. vif, vprm, vpu, nef, and combinations thereof). Unlike the first-generation lentiviral vectors, no single second generation lentiviral vector includes all features necessary to express and package a polynucleotide into a virus particle. In some embodiments, the envelope and packaging components are split between two different vectors with the gag, pol, rev, and tat genes being contained on one vector and the envelope protein (e.g. VSV-G) are contained on a second vector. The gene of interest, its promoter, and LTRs can be included on a third vector that can be used in conjunction with the other two vectors (packaging and envelope vectors) to generate a replication-incompetent virus particle.

In some embodiments, the lentiviral vector or vector system thereof can be a third-generation lentiviral vector or vector system thereof. Third-generation lentiviral vectors and vector systems thereof have increased safety over first- and second-generation lentiviral vectors and systems thereof because, for example, the various components of the viral genome are split between two or more different vectors but used together in vitro to make virus particles, they can lack the tat gene (when a constitutively active promoter is included up-stream of the LTRs), and they can include one or more deletions in the 3'LTR to create self-inactivating (SIN) vectors having disrupted promoter/enhancer activity of the LTR. In some embodiments, a third-generation lentiviral vector system can include (i) a vector plasmid that contains the polynucleotide of interest and upstream promoter that are flanked by the 5' and 3' LTRs, which can optionally include one or more deletions present in one or both of the LTRs to render the vector self-inactivating; (ii) a "packaging vector(s)" that can contain one or more genes involved in packaging a polynucleotide into a virus particle that is produced by the system (e.g. gag, pol, and rev) and upstream regulatory sequences (e.g. promoter(s)) to drive expression of the features present on the packaging vector, and (iii) an "envelope vector" that contains one or more envelope protein genes and upstream promoters. In certain embodiments, the third-generation lentiviral vector system can include at least two packaging vectors, with the gag-pol being present on a different vector than the rev gene.

In some embodiments, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) can be used/and or adapted to the perturbation construct of the present invention.

In some embodiments, the pseudotype and infectivity or tropism of a lentivirus particle can be tuned by altering the type of envelope protein(s) included in the lentiviral vector or system thereof. As used herein, an "envelope protein" or "outer protein" means a protein exposed at the surface of a viral particle that is not a capsid protein. For example, envelope or outer proteins typically comprise proteins embedded in the envelope of the virus. In some embodiments, a lentiviral vector or vector system thereof can include a VSV-G envelope protein. VSV-G mediates viral attachment to an LDL receptor (LDLR) or an LDLR family member present on a host cell, which triggers endocytosis of the viral particle by the host cell. Because LDLR is expressed by a wide variety of cells, viral particles expressing the VSV-G envelope protein can infect or transduce a wide variety of cell types. Other suitable envelope proteins can be incorporated based on the host cell that a user desires to be infected by a virus particle produced from a lentiviral vector or system thereof described herein and can include, but are not limited to, feline endogenous virus envelope protein (RD 114) (see e.g. Hanawa et al. Molec. Ther. 2002 5(3) 242-251), modified Sindbis virus envelope proteins (see e.g. Morizono et al. 2010. J. Virol. 84(14) 6923-6934; Morizono et al. 2001. J. Virol. 75:8016-8020; Morizono et al. 2009. J. Gene Med. 11:549-558; Morizono et al. 2006 Virology 355:71-81; Morizono et al J. Gene Med. 11:655-663, Morizono et al. 2005 Nat. Med. 11:346-352), baboon retroviral envelope protein (see e.g. Girard-Gagnepain et al. 2014. Blood. 124: 1221-1231); Tupaia paramyxovirus glycoproteins (see e.g. Enkirch T. et al., 2013. Gene Ther. 20:16-23); measles virus glycoproteins (see e.g. Funke et al. 2008. Molec. Ther. 16(8): 1427-1436), rabies virus envelope proteins, MLV envelope proteins, Ebola envelope proteins, baculovirus envelope proteins, filovirus envelope proteins, hepatitis E1 and E2 envelope proteins, gp41 and gp120 of HIV, hemagglutinin, neuraminidase, M2 proteins of influenza virus, and combinations thereof.

In some embodiments, the tropism of the resulting lentiviral particle can be tuned by incorporating cell targeting peptides into a lentiviral vector such that the cell targeting peptides are expressed on the surface of the resulting lentiviral particle. In some embodiments, a lentiviral vector can contain an envelope protein that is fused to a cell targeting protein (see e.g. Buchholz et al. 2015. Trends Biotechnol. 33:777-790; Bender et al. 2016. PLoS Pathog. 12(e1005461); and Friedrich et al. 2013. Mol. Ther. 2013. 21: 849-859.

In some embodiments, a split-intein-mediated approach to target lentiviral particles to a specific cell type can be used (see e.g. Chamoun-Emaneulli et al. 2015. Biotechnol. Bioeng. 112:2611-2617, Ramirez et al. 2013. Protein. Eng. Des. Sel. 26:215-233. In these embodiments, a lentiviral vector can contain one half of a splicing-deficient variant of the naturally split intein from *Nostoc punctiforme* fused to a cell targeting peptide and the same or different lentiviral vector can contain the other half of the split intein fused to an envelope protein, such as a binding-deficient, fusion-competent virus envelope protein. This can result in production of a virus particle from the lentiviral vector or vector system that includes a split intein that can function as a molecular Velcro linker to link the cell-binding protein to the pseudotyped lentivirus particle. This approach can be advantageous for use where surface-incompatibilities can restrict the use of, e.g., cell targeting peptides.

In some embodiments, a covalent-bond-forming protein-peptide pair can be incorporated into one or more of the lentiviral vectors described herein to conjugate a cell targeting peptide to the virus particle (see e.g. Kasaraneni et al. 2018. Sci. Reports (8) No. 10990). In some embodiments, a lentiviral vector can include an N-terminal PDZ domain of InaD protein (PDZ1) and its pentapeptide ligand (TEFCA) from NorpA, which can conjugate the cell targeting peptide to the virus particle via a covalent bond (e.g. a disulfide bond). In some embodiments, the PDZ1 protein can be fused to an envelope protein, which can optionally be binding deficient and/or fusion competent virus envelope protein and included in a lentiviral vector. In some embodiments, the TEFCA can be fused to a cell targeting peptide and the TEFCA-CPT fusion construct can be incorporated into the same or a different lentiviral vector as the PDZ1-envelope protein construct. During virus production, specific interaction between the PDZ1 and TEFCA facilitates producing virus particles covalently functionalized with the cell targeting peptide and thus capable of targeting a specific cell-type based upon a specific interaction between the cell targeting peptide and cells expressing its binding partner. This approach can be advantageous for use where surface-incompatibilities can restrict the use of, e.g., cell targeting peptides.

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015. Any of these systems or a variant thereof can be used to deliver a perturbation construct described herein to a cell.

In some embodiments, a lentiviral vector system can include one or more transfer plasmids. Transfer plasmids can be generated from various other vector backbones and can include one or more features that can work with other retroviral and/or lentiviral vectors in the system that can, for example, improve safety of the vector and/or vector system, increase virial titers, and/or increase or otherwise enhance expression of the desired insert to be expressed and/or packaged into the viral particle. Suitable features that can be included in a transfer plasmid can include, but are not limited to, 5'LTR, 3'LTR, SIN/LTR, origin of replication (Ori), selectable marker genes (e.g. antibiotic resistance genes), Psi (Ψ), RRE (rev response element), cPPT (central polypurine tract), promoters, WPRE (woodchuck hepatitis post-transcriptional regulatory element), SV40 polyadenylation signal, pUC origin, SV40 origin, F1 origin, and combinations thereof.

In another embodiment, Cocal vesiculovirus envelope pseudotyped retroviral or lentiviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. In certain embodiments of these embodiments, the Gag, Pol, and accessory proteins are lentiviral and/or gammaretroviral. In some embodiments, a retroviral vector can contain encoding polypeptides for one or more Cocal vesiculovirus envelope proteins such that the resulting viral or pseudoviral particles are Cocal vesiculovirus envelope pseudotyped.

Adenoviral Vectors, Helper-Dependent Adenoviral Vectors, and Hybrid Adenoviral Vectors In some embodiments, the vector can be an adenoviral vector. In some embodiments, the adenoviral vector can include elements such that the virus particle produced using the vector or system thereof can be serotype 2 or serotype 5. In some embodiments, the polynucleotide to be delivered via the adenoviral particle can be up to about 8 kb. Thus, in some embodiments, an adenoviral vector can include a DNA polynucleotide to be delivered that can range in size from about 0.001 kb to about 8 kb. Adenoviral vectors have been used successfully in several contexts (see e.g. Teramato et al. 2000. Lancet. 355:1911-1912; Lai et al. 2002. DNA Cell. Biol. 21:895-913; Flotte et al., 1996. Hum. Gene. Ther. 7:1145-1159; and Kay et al. 2000. Nat. Genet. 24:257-261.

In some embodiments the vector can be a helper-dependent adenoviral vector or system thereof. These are also referred to in the art as "gutless" or "gutted" vectors and are a modified generation of adenoviral vectors (see e.g. Thrasher et al. 2006. Nature. 443:E5-7). In certain embodiments of the helper-dependent adenoviral vector system one vector (the helper) can contain all the viral genes required for replication but contains a conditional gene defect in the packaging domain. The second vector of the system can contain only the ends of the viral genome, one or more CRISPR-Cas polynucleotides, and the native packaging recognition signal, which can allow selective packaged release from the cells (see e.g. Cideciyan et al. 2009. N Engl J Med. 361:725-727). Helper-dependent adenoviral vector systems have been successful for gene delivery in several contexts (see e.g. Simonelli et al. 2010. J Am Soc Gene Ther. 18:643-650; Cideciyan et al. 2009. N Engl J Med. 361:725-727; Crane et al. 2012. Gene Ther. 19(4):443-452; Alba et al. 2005. Gene Ther. 12:18-S27; Croyle et al. 2005. Gene Ther. 12:579-587; Amalfitano et al. 1998. J. Virol. 72:926-933; and Morral et al. 1999. PNAS. 96:12816-12821). The techniques and vectors described in these publications can be adapted for inclusion and delivery of the CRISPR-Cas system polynucleotides described herein. In some embodiments, the polynucleotide to be delivered via the viral particle produced from a helper-dependent adenoviral vector or system thereof can be up to about 37 kb. Thus, in some embodiments, a adenoviral vector can include a DNA polynucleotide to be delivered that can range in size from about 0.001 kb to about 37 kb (see e.g. Rosewell et al. 2011. J. Genet. Syndr. Gene Ther. Suppl. 5:001).

In some embodiments, the vector is a hybrid-adenoviral vector or system thereof. Hybrid adenoviral vectors are composed of the high transduction efficiency of a gene-deleted adenoviral vector and the long-term genome-integrating potential of adeno-associated, retroviruses, lentivirus, and transposon based-gene transfer. In some embodiments, such hybrid vector systems can result in stable transduction and limited integration site. See e.g. Balague et al. 2000. Blood. 95:820-828; Morral et al. 1998. Hum. Gene Ther. 9:2709-2716; Kubo and Mitani. 2003. J. Virol. 77(5): 2964-2971; Zhang et al. 2013. PloS One. 8(10) e76771; and Cooney et al. 2015. Mol. Ther. 23(4):667-674), whose techniques and vectors described therein can be modified and adapted for use in the CRISPR-Cas system of the present invention. In some embodiments, a hybrid-adenoviral vector can include one or more features of a retrovirus and/or an adeno-associated virus. In some embodiments the hybrid-adenoviral vector can include one or more features of a spuma retrovirus or foamy virus (FV). See e.g. Ehrhardt et al. 2007. Mol. Ther. 15:146-156 and Liu et al. 2007. Mol. Ther. 15:1834-1841, whose techniques and vectors described therein can be modified and adapted for use in the CRISPR-Cas system of the present invention. Advantages of using one or more features from the FVs in the hybrid-adenoviral vector or system thereof can include the ability of the viral particles produced therefrom to infect a broad range of cells, a large packaging capacity as compared to other retroviruses, and the ability to persist in quiescent (non-dividing) cells. See also e.g. Ehrhardt et al. 2007. Mol. Ther. 156:146-156 and Shuji et al. 2011. Mol. Ther. 19:76-82, whose techniques and vectors described therein can be modified and adapted for use in the perturbation construct of the present invention.

Adeno Associated Viral (AAV) Vectors

In an embodiment, the vector can be an adeno-associated virus (AAV) vector. See, e.g., West et al., Virology 160:38-47 (1987); U.S. Pat. No. 4,797,368; WO 93/24641; Kotin, Human Gene Therapy 5:793-801 (1994); and Muzyczka, J. Clin. Invest. 94:1351 (1994). Although similar to adenoviral vectors in some of their features, AAVs have some deficiency in their replication and/or pathogenicity and thus can be safer that adenoviral vectors. In some embodiments the AAV can integrate into a specific site on chromosome 19 of a human cell with no observable side effects. In some embodiments, the capacity of the AAV vector, system thereof, and/or AAV particles can be up to about 4.7 kb. The AAV vector or system thereof can include one or more regulatory molecules. In some embodiments the regulatory molecules can be promoters, enhancers, repressors and the like, which are described in greater detail elsewhere herein. In some embodiments, the AAV vector or system thereof can include one or more polynucleotides that can encode one or more regulatory proteins. In some embodiments, the one or more regulatory proteins can be selected from Rep78, Rep68, Rep52, Rep40, variants thereof, and combinations thereof.

The AAV vector or system thereof can include one or more polynucleotides that can encode one or more capsid proteins. The capsid proteins can be selected from VP1, VP2, VP3, and combinations thereof. The capsid proteins can be capable of assembling into a protein shell of the AAV virus particle. In some embodiments, the AAV capsid can contain 60 capsid proteins. In some embodiments, the ratio of VP1:VP2:VP3 in a capsid can be about 1:1:10.

In some embodiments, the AAV vector or system thereof can include one or more adenovirus helper factors or polynucleotides that can encode one or more adenovirus helper factors. Such adenovirus helper factors can include, but are not limited, E1A, E1B, E2A, E4ORF6, and VA RNAs. In some embodiments, a producing host cell line expresses one or more of the adenovirus helper factors.

The AAV vector or system thereof can be configured to produce AAV particles having a specific serotype. In some embodiments, the serotype can be AAV-1, AAV-2, AAV-3, AAV-4, AAV-5, AAV-6, AAV-8, AAV-9 or any combinations thereof. In some embodiments, the AAV can be AAV1, AAV-2, AAV-5 or any combination thereof. One can select the AAV of the AAV with regard to the cells to be targeted; e.g., one can select AAV serotypes 1, 2, 5 or a hybrid capsid AAV-1, AAV-2, AAV-5 or any combination thereof for targeting brain and/or neuronal cells; and one can select AAV-4 for targeting cardiac tissue; and one can select AAV8 for delivery to the liver. Thus, in some embodiments, an AAV vector or system thereof capable of producing AAV particles capable of targeting the brain and/or neuronal cells can be configured to generate AAV particles having serotypes 1, 2, 5 or a hybrid capsid AAV-1, AAV-2, AAV-5 or any combination thereof. In some embodiments, an AAV vector or system thereof capable of producing AAV particles capable of targeting cardiac tissue can be configured to generate an AAV particle having an AAV-4 serotype. In some embodiments, an AAV vector or system thereof capable of producing AAV particles capable of targeting the liver can be configured to generate an AAV having an AAV-8 serotype. In some embodiments, the AAV vector is a hybrid AAV vector or system thereof. Hybrid AAVs are AAVs that include genomes with elements from one serotype that are packaged into a capsid derived from at least one different serotype. For example, if it is the rAAV2/5 that is to be produced, and if the production method is based on the helper-free, transient transfection method discussed above, the 1st plasmid and the 3rd plasmid (the adeno helper plasmid) will be the same as discussed for rAAV2 production. However, the second plasmid, the pRepCap will be different. In this plasmid, called pRep2/Cap5, the Rep gene is still derived from AAV2, while the Cap gene is derived from AAV5. The production scheme is the same as the above-mentioned approach for AAV2 production. The resulting rAAV is called rAAV2/5, in which the genome is based on recombinant AAV2, while the capsid is based on AAV5. It is assumed the cell or tissue-tropism displayed by this AAV2/5 hybrid virus should be the same as that of AAV5.

A tabulation of certain AAV serotypes as to these cells can be found in Grimm, D. et al, J. Virol. 82: 5887-5911 (2008).

In some embodiments, the AAV vector or system thereof is configured as a "gutless" vector, similar to that described in connection with a retroviral vector. In some embodiments, the "gutless" AAV vector or system thereof can have the cis-acting viral DNA elements involved in genome amplification and packaging in linkage with the heterologous sequences of interest (e.g. the perturbation construct (s)).

In some embodiments, the AAV vectors are produced in in insect cells, e.g., *Spodoptera frugiperda* Sf9 insect cells, grown in serum-free suspension culture. Serum-free insect cells can be purchased from commercial vendors, e.g., Sigma Aldrich (EX-CELL 405).

In some embodiments, an AAV vector or vector system can contain or consists essentially of one or more polynucleotides encoding one or more components of a perturbation construct described herein. In some embodiments, the AAV vector or vector system can contain a plurality of cassettes comprising or consisting a first cassette comprising or consisting essentially of a two or more gRNAs (or their encoding polynucleotides), reporter gene, barcode, and a terminator, advantageously up to the packaging size limit of the vector, e.g., in total.

In one embodiment, the invention provides a non-naturally occurring or engineered composition comprising a perturbation construct, which is part of or tethered to an AAV capsid domain, i.e., VP1, VP2, or VP3 domain of Adeno-Associated Virus (AAV) capsid. In some embodiments, part of or tethered to an AAV capsid domain includes associated with associated with an AAV capsid domain. In some embodiments, the perturbation construct may be fused to the AAV capsid domain. In some embodiments, the fusion may be to the N-terminal end of the AAV capsid domain. As such, in some embodiments, the C-terminal end of the CRISPR enzyme is fused to the N-terminal end of the AAV capsid domain. In some embodiments, an NLS and/or a linker (such as a GlySer linker) may be positioned between the C-terminal end of the CRISPR enzyme and the N-terminal end of the AAV capsid domain. In some embodiments, the fusion may be to the C-terminal end of the AAV capsid domain. In some embodiments, this is not preferred due to the fact that the VP1, VP2 and VP3 domains of AAV are alternative splices of the same RNA and so a C-terminal fusion may affect all three domains. In some embodiments, the AAV capsid domain is truncated. In some embodiments, some or all of the AAV capsid domain is removed. In some embodiments, some of the AAV capsid domain is removed and replaced with a linker (such as a GlySer linker), typically leaving the N-terminal and C-terminal ends of the AAV capsid domain intact, such as the first 2, 5 or 10 amino acids. In this way, the internal (non-terminal) portion of the VP3 domain may be replaced with a linker. It is particularly preferred that the linker is fused to the CRISPR protein. A branched linker may be used, with the perturbation construct or component thereof fused to the end of one of the branches. This allows for some degree of spatial separation between the capsid and the perturbation construct or component thereof. In this way, the perturbation construct or component thereof is part of (or fused to) the AAV capsid domain.

In other embodiments, the perturbation construct or component thereof may be fused in frame within, i.e. internal to, the AAV capsid domain. Thus, in some embodiments, the AAV capsid domain again preferably retains its N-terminal and C-terminal ends. In this case, a linker is preferred, in some embodiments, either at one or both ends of the perturbation construct. In this way, the perturbation construct or component thereof is again part of (or fused to) the AAV capsid domain. In certain embodiments, the positioning of the perturbation construct or component thereof is such that the perturbation construct or component thereof is at the external surface of the viral capsid once formed. In one embodiment, the invention provides a non-naturally occurring or engineered composition comprising a perturbation construct or component thereof associated with a AAV capsid domain of Adeno-Associated Virus (AAV) capsid. Here, associated may mean in some embodiments fused, or in some embodiments bound to, or in some embodiments tethered to. The perturbation construct or component thereof may, in some embodiments, be tethered to the VP1, VP2, or VP3 domain. This may be via a connector protein or tethering system such as the biotin-streptavidin system. In one example, a biotinylation sequence (15 amino acids) could therefore be fused to the perturbation construct or component thereof. When a fusion of the AAV capsid domain, especially the N-terminus of the AAV AAV capsid domain, with streptavidin is also provided, the two will therefore associate with very high affinity. Thus, in some embodiments, provided is a composition or system comprising a perturbation construct or component thereof—biotin fusion and a streptavidin—AAV capsid domain arrangement, such as a fusion. The perturbation construct or component thereof—biotin and streptavidin—AAV capsid domain forms a single complex when the two parts are brought together. NLSs may also be incorporated between the perturbation construct or component thereof and the biotin; and/or between the streptavidin and the AAV capsid domain.

As such, provided is a fusion of a perturbation construct or component thereof with a connector protein specific for a high affinity ligand for that connector, whereas the AAV VP2 domain is bound to said high affinity ligand. For example, streptavidin may be the connector fused to the CRISPR enzyme, while biotin may be bound to the AAV VP2 domain. Upon co-localization, the streptavidin will bind to the biotin, thus connecting the perturbation construct or component thereof to the AAV VP2 domain. The reverse arrangement is also possible. In some embodiments, a biotinylation sequence (15 amino acids) could therefore be fused to the AAV VP2 domain, especially the N-terminus of the AAV VP2 domain. A fusion of the perturbation construct or component thereof with streptavidin is also preferred, in some embodiments. In some embodiments, the biotinylated AAV capsids with streptavidin-perturbation construct or component thereof are assembled in vitro. This way the AAV capsids should assemble in a straightforward manner and the perturbation construct or component thereof—streptavidin fusion can be added after assembly of the capsid. In other embodiments a biotinylation sequence (15 amino acids) could therefore be fused to the perturbation construct or component thereof, together with a fusion of the AAV VP2 domain, especially the N-terminus of the AAV VP2 domain, with streptavidin. For simplicity, a fusion of the perturbation construct or component thereof and the AAV VP2 domain is preferred in some embodiments. In some embodiments, the fusion may be to the N-terminal end of the perturbation construct or component thereof. In other words, in some embodiments, the AAV and perturbation construct or component thereof are associated via fusion. In some embodiments, the AAV and perturbation construct or component thereof are associated via fusion including a linker. Suitable linkers are discussed herein include, but are not limited to, Gly Ser linkers. Fusion to the N-term of AAV VP2 domain is preferred, in some embodiments. In some embodiments, the perturbation construct or component thereof comprises at least one Nuclear Localization Signal (NLS). In a further embodiment, the present invention provides compositions comprising the perturbation construct or component thereof and associated AAV VP2 domain or the polynucleotides or vectors described herein. Such compositions and formulations are discussed elsewhere herein.

An alternative tether may be to fuse or otherwise associate the AAV capsid domain to an adaptor protein which binds to or recognizes to a corresponding RNA sequence or motif. In some embodiments, the adaptor is or comprises a binding protein which recognizes and binds (or is bound by) an RNA sequence specific for said binding protein. In some embodiments, a preferred example is the MS2 (see Konermann et al. December 2014, cited infra, incorporated herein by reference) binding protein which recognizes and binds (or is bound by) an RNA sequence specific for the MS2 protein.

With the AAV capsid domain associated with the adaptor protein, the perturbation construct or component thereof may, in some embodiments, be tethered to the adaptor protein of the AAV capsid domain. The perturbation construct or component thereof may, in some embodiments, be tethered to the adaptor protein of the AAV capsid domain via the C perturbation construct or component thereof being in a complex with a modified guide, see Konermann et al. The modified guide is, in some embodiments, a sgRNA. In some embodiments, the modified guide comprises a distinct RNA sequence; see, e.g., International Patent Application No. PCT/US14/70175, incorporated herein by reference.

In some embodiments, distinct RNA sequence is an aptamer. Thus, corresponding aptamer-adaptor protein systems are preferred. One or more functional domains may also be associated with the adaptor protein. An example of a preferred arrangement would be: [AAV AAV capsid domain-adaptor protein]-[modified guide-perturbation construct or component thereof]

In certain embodiments, the positioning of the perturbation construct or component thereof is such that the perturbation construct or component thereof is at the internal surface of the viral capsid once formed. In one embodiment, the invention provides a non-naturally occurring or engineered composition comprising a perturbation construct or component thereof associated with an internal surface of an AAV capsid domain. Here again, associated may mean in some embodiments fused, or in some embodiments bound to, or in some embodiments tethered to. The perturbation construct or component thereof may, in some embodiments, be tethered to the VP1, VP2, or VP3 domain such that it locates to the internal surface of the viral capsid once formed. This may be via a connector protein or tethering system such as the biotin-streptavidin system as described above and/or elsewhere herein.

Herpes Simplex Viral Vectors

In some embodiments, the vector can be a Herpes Simplex Viral (HSV)-based vector or system thereof. HSV systems can include the disabled infections single copy (DISC) viruses, which are composed of a glycoprotein H defective mutant HSV genome. When the defective HSV is propagated in complementing cells, virus particles can be generated that are capable of infecting subsequent cells permanently replicating their own genome but are not capable of producing more infectious particles. See e.g. 2009. Trobridge. Exp. Opin. Biol. Ther. 9:1427-1436, whose techniques and vectors described therein can be modified and adapted for use in the CRISPR-Cas system of the present invention. In some embodiments where an HSV vector or system thereof is utilized, the host cell can be a complementing cell. In some embodiments, HSV vector or system thereof can be capable of producing virus particles capable of delivering a polynucleotide cargo of up to 150 kb. Thus, in some embodiment the CRISPR-Cas system polynucleotide(s) included in the HSV-based viral vector or system thereof can sum from about 0.001 to about 150 kb. HSV-based vectors and systems thereof have been successfully used in several contexts including various models of neurologic disorders. See e.g. Cockrell et al. 2007. Mol. Biotechnol. 36:184-204; Kafri T. 2004. Mol. Biol. 246:367-390; Balaggan and Ali. 2012. Gene Ther. 19:145-153; Wong et al. 2006. Hum. Gen. Ther. 2002. 17:1-9; Azzouz et al. J. Neruosci. 22L10302-10312; and Betchen and Kaplitt. 2003. Curr. Opin. Neurol. 16:487-493, whose techniques and vectors described therein can be modified and adapted for use in the CRISPR-Cas system of the present invention.

Poxvirus Vectors

In some embodiments, the vector can be a poxvirus vector or system thereof. In some embodiments, the poxvirus vector can result in cytoplasmic expression of perturbation construct or component thereof the present invention. In some embodiments the capacity of a poxvirus vector or system thereof can be about 25 kb or more. In some embodiments, a poxvirus vector or system thereof can include one or more perturbation constructs or component thereof described herein.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of 104-109 cells per kg body weight, preferably $10^1$ to $10^6$ cells/kg body weight including all integer values of cell numbers within those ranges. Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administered as a single dose. In another embodiment, the effective amount of cells are administered as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective number of cells or composition comprising those cells are administrated parenterally. The administration can be an intravenous administration. The administration can be directly done by injection.

Screening

In particular embodiments, compounds are tested for their effects on the metabolic pathway described herein for cholesterol, for coprostanone or cholesterone, and/or for its effects on the COR proteins described herein. Methods of screening subject for increased risk of high cholesterol or an Inflammatory Bowel Disease are provided, comprising detecting the presence of one or more COR encoding microbes in the gut of a subject. In an aspect, detecting the presence of one or more COR encoding microbes in the subject comprises culturing one or more COR encoding microbes or detecting of one or more microbial COR genes or proteins in the fecal sample of the subject. Culturing and extracting from samples can be as known in the art, see, e.g. Lloyd-Price, J. et al. Multi-omics of the gut microbial ecosystem in inflammatory bowel diseases. Nature 569, 655-662 (2019), incorporated herein by reference.

Particular screening applications of this invention relate to the testing of pharmaceutical compounds in drug research. The reader is referred generally to the standard textbook In vitro Methods in Pharmaceutical Research, Academic Press, 1997, and U.S. Pat. No. 5,030,015. In certain aspects of this invention, the culture is used to grow cells to play the role of test cells for standard drug screening and toxicity assays. Assessment of the activity of candidate pharmaceutical compounds generally involves combining the target cell (e.g., a myocyte, an adipocyte, a enterocyte, a cardiomyocyte or a hepatocyte) with the candidate compound, determining any change in the morphology, marker phenotype, or metabolic activity of the cells that is attributable to the candidate compound (compared with untreated cells or cells treated with an inert compound, such as vehicle), and then correlating the effect of the candidate compound with the observed change. The screening may be done because the candidate compound is designed to have a pharmacological effect on the target cell, or because a candidate compound may have unintended side effects on the target cell, e.g. gut cell. Alternatively, libraries can be screened without any predetermined expectations in hopes of identifying compounds with desired effects. Cytotoxicity can be determined in the first instance by the effect on cell viability and morphology. In certain embodiments, toxicity may be assessed by observation of vital staining techniques, ELISA assays, immunohistochemistry, and the like or by analyzing the cellular content of the culture, e.g., by total cell counts, and differential cell counts or by metabolic markers such as MTT and XTT.

Additional further uses of the culture include, but are not limited to, its use in research e.g., to elucidate mechanisms leading to the identification of novel targets for therapies, and to generate genotype-specific cells for disease modeling, including the generation of new therapies customized to different genotypes. Such customization can reduce adverse drug effects and help identify therapies appropriate to the patient's genotype.

In certain embodiments, the present invention provides method for high-throughput screening. "High-throughput screening" (HTS) refers to a process that uses a combination of modern robotics, data processing and control software, liquid handling devices, and/or sensitive detectors, to efficiently process a large amount of (e.g., thousands, hundreds of thousands, or millions of) samples in biochemical, genetic or pharmacological experiments, either in parallel or in sequence, within a reasonably short period of time (e.g., days). Preferably, the process is amenable to automation, such as robotic simultaneous handling of 96 samples, 384 samples, 1536 samples or more. A typical HTS robot tests up to 100,000 to a few hundred thousand compounds per day. The samples are often in small volumes, such as no more than 1 mL, 500 µl, 200 µl, 100 µl, 50 µl or less. Through this process, one can rapidly identify active compounds, small molecules, antibodies, proteins or polynucleotides which modulate a particular biomolecular/genetic pathway. The results of these experiments provide starting points for further drug design and for understanding the interaction or role of a particular biochemical process in biology. Thus "high-throughput screening" as used herein does not include handling large quantities of radioactive materials, slow and complicated operator-dependent screening steps, and/or prohibitively expensive reagent costs, etc.

A further aspect of the invention relates to a method for identifying an agent capable of modulating one or more phenotypic aspects of a gut cell or gut cell population as disclosed herein, comprising: a) applying a candidate agent to the cell or cell population; b) detecting modulation of one or more phenotypic aspects of the cell or cell population by the candidate agent, thereby identifying the agent.

The term "modulate" broadly denotes a qualitative and/or quantitative alteration, change or variation in that which is being modulated. Where modulation can be assessed quantitatively—for example, where modulation comprises or consists of a change in a quantifiable variable such as a quantifiable property of a cell or where a quantifiable variable provides a suitable surrogate for the modulation—modulation specifically encompasses both increase (e.g., activation) or decrease (e.g., inhibition) in the measured variable. The term encompasses any extent of such modulation, e.g., any extent of such increase or decrease, and may more particularly refer to statistically significant increase or decrease in the measured variable. By means of example, modulation may encompass an increase in the value of the measured variable by at least about 10%, e.g., by at least about 20%, preferably by at least about 30%, e.g., by at least about 40%, more preferably by at least about 50%, e.g., by at least about 75%, even more preferably by at least about 100%, e.g., by at least about 150%, 200%, 250%, 300%, 400% or by at least about 500%, compared to a reference situation without said modulation; or modulation may encompass a decrease or reduction in the value of the measured variable by at least about 10%, e.g., by at least about 20%, by at least about 30%, e.g., by at least about 40%, by at least about 50%, e.g., by at least about 60%, by at least about 70%, e.g., by at least about 80%, by at least about 90%, e.g., by at least about 95%, such as by at least about 96%, 97%, 98%, 99% or even by 100%, compared to a reference situation without said modulation. Preferably, modulation may be specific or selective, hence, one or more desired phenotypic aspects of a gut cell or gut cell population may be modulated without substantially altering other (unintended, undesired) phenotypic aspect(s).

The term "agent" broadly encompasses any condition, substance or agent capable of modulating one or more phenotypic aspects of a gut cell or gut cell population as disclosed herein. Such conditions, substances or agents may be of physical, chemical, biochemical and/or biological nature. The term "candidate agent" refers to any condition, substance or agent that is being examined for the ability to modulate one or more phenotypic aspects of an gut cell or gut cell population as disclosed herein in a method comprising applying the candidate agent to the gut cell or gut cell population (e.g., exposing the gut cell or gut cell population to the candidate agent or contacting the gut cell or gut cell population with the candidate agent) and observing whether the desired modulation takes place.

Agents may include any potential class of biologically active conditions, substances or agents, such as for instance antibodies, proteins, peptides, nucleic acids, oligonucleotides, small molecules, or combinations thereof.

By means of example but without limitation, agents can include low molecular weight compounds, but may also be larger compounds, or any organic or inorganic molecule effective in the given situation, including modified and unmodified nucleic acids such as antisense nucleic acids, RNAi, such as siRNA or shRNA, CRISPR/Cas systems, peptides, peptidomimetics, receptors, ligands, and antibodies, aptamers, polypeptides, nucleic acid analogues or variants thereof. Examples include an oligomer of nucleic acids, amino acids, or carbohydrates including without limitation proteins, oligonucleotides, ribozymes, DNAzymes, glycoproteins, siRNAs, lipoproteins, aptamers, and modifications and combinations thereof. Agents can be selected from a group comprising: chemicals; small molecules; nucleic acid sequences; nucleic acid analogues; proteins; peptides; aptamers; antibodies; or fragments thereof. A nucleic acid sequence can be RNA or DNA, and can be single or double stranded, and can be selected from a group comprising; nucleic acid encoding a protein of interest, oligonucleotides, nucleic acid analogues, for example peptide-nucleic acid (PNA), pseudo-complementary PNA (pc-PNA), locked nucleic acid (LNA), modified RNA (mod-RNA), single guide RNA etc. Such nucleic acid sequences include, for example, but are not limited to, nucleic acid sequence encoding proteins, for example that act as transcriptional repressors, antisense molecules, ribozymes, small inhibitory nucleic acid sequences, for example but not limited to RNAi, shRNAi, siRNA, micro RNAi (mRNAi), antisense oligonucleotides, CRISPR guide RNA, for example that target a CRISPR enzyme to a specific DNA target sequence etc. A protein and/or peptide or fragment thereof can be any protein of interest, for example, but are not limited to: mutated proteins; therapeutic proteins and truncated proteins, wherein the protein is normally absent or expressed at lower levels in the cell. Proteins can also be selected from a group comprising; mutated proteins, genetically engineered proteins, peptides, synthetic peptides, recombinant proteins, chimeric proteins, antibodies, midibodies, minibodies, triabodies, humanized proteins, humanized antibodies, chimeric antibodies, modified proteins and fragments thereof. Alternatively, the agent can be intracellular within the cell as a result of introduction of a nucleic acid sequence into the cell and its transcription resulting in the production of the nucleic acid and/or protein modulator of a gene within the cell. In some embodiments, the agent is any chemical, entity or moiety, including without limitation synthetic and naturally-occurring non-proteinaceous entities. In certain embodiments, the agent is a small molecule having a chemical moiety. Agents can be known to have a desired activity and/or property, or can be selected from a library of diverse compounds.

In certain embodiments, an agent may be a hormone, a cytokine, a lymphokine, a growth factor, a chemokine, a cell surface receptor ligand such as a cell surface receptor agonist or antagonist, or a mitogen.

Methods of Treatment

Also provided is a method of treating a subject, e.g., a subject in need thereof, comprising delivering a steroid or sterol as described herein, a microbe as described herein, or a probiotic as described. Methods of reducing serum triglycerides and/or total cholesterol are provided and can comprise administering an engineered microbe as described herein, a probiotic composition as described herein, or a coprostanol or a variant thereof to a subject in need thereof.

Methods of reducing cholesterol uptake in a subject are also provided, comprising delivering coprostanol or variant thereof in an effective amount to lower serum cholesterol in the subject. In particular embodiments, the coprostanol or a variant thereof is provided in a water dispersible solid form.

In certain embodiments, the coprostanol or variant thereof can be prepared in a water dispersible solid form. As an example, U.S. Pat. No. 6,387,411 describes methods of admixing hydrocarbon with stanols and/or sterols to make water dispersible products. Preparing sterol/stanol and sterol/stanol ester compositions with improved dispersibility is provided by co-melting the sterol/stanol and/or sterol/stanol ester with highly branched hydrocarbons and then grinding the resulting product.

Methods of reducing serum triglycerides and/or total cholesterol are provided and can comprise administering an engineered microbe as described herein, a probiotic composition as described herein, or a coprostanol or a variant thereof to a subject in need thereof.

In particular embodiments, methods of reducing uptake of serum triglycerides and/or total cholesterol are administered to a subject in need thereof. In one aspect, the subject has hypercholesterolemia.

Where any treatment is occurring ex vivo, for example in a cell culture, then it will be appreciated that the term 'subject' may be replaced by the phrase "cell or cell culture."

Compositions comprising the present system for use in said method of treatment are also provided. A kit of parts may be provided including such compositions.

In particular embodiments, methods of reducing uptake or serum triglycerides and/or total cholesterol are administered to a subject in need thereof. In one aspect, the subject has hypercholesterolemia.

In some embodiments, the microbe, e.g., is delivered to the tissue of interest by, for example, an intramuscular injection, while other times the delivery is via intravenous, transdermal, intranasal, oral, mucosal, or other delivery methods. Such delivery may be either via a single dose, or multiple doses. Fecal Microbiota Transplant (FMT) infusion in the colon is one manner of delivery. See, e.g. Kim et al., Fecal Microbiota Transplantation: An Update on Clinical Practice, Clin. Endosc. 2019 Ma; 52(2: 1376-143, doi: 10.5946/ce.2019.009. Oral administration of the probiotics as described herein are another preferred route of administration. The methods of treatment may be combined with screening methods as described herein. In an example embodiment, screening methods may determine a subject in need of a method of treatment, e.g., upon screening and determination of a subject with elevated cholesterol in serum or stool, or a lower content of COR enzymes in a sample, administration of probiotics, COR expressing microbes, and/or compositions as described herein can be provided.

One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The terms "diagnosis" and "monitoring" are commonplace and well-understood in medical practice. By means of further explanation and without limitation the term "diagnosis" generally refers to the process or act of recognising, deciding on or concluding on a disease or condition in a subject on the basis of symptoms and signs and/or from results of various diagnostic procedures (such as, for example, from knowing the presence, absence and/or quantity of one or more biomarkers characteristic of the diagnosed disease or condition).

The terms "prognosing" or "prognosis" generally refer to an anticipation on the progression of a disease or condition and the prospect (e.g., the probability, duration, and/or extent) of recovery. A good prognosis of the diseases or conditions taught herein may generally encompass anticipation of a satisfactory partial or complete recovery from the diseases or conditions, preferably within an acceptable time period. A good prognosis of such may more commonly encompass anticipation of not further worsening or aggravating of such, preferably within a given time period. A poor prognosis of the diseases or conditions as taught herein may generally encompass anticipation of a substandard recovery and/or unsatisfactorily slow recovery, or to substantially no recovery or even further worsening of such.

The one or more COR homologs and/or microbes of the present invention are useful in methods of identifying patient populations at risk or suffering from an immune response based on a detected level of expression, activity and/or function of one or more COR homologs and/or microbes. These biomarkers are also useful in monitoring subjects undergoing treatments and therapies for suitable or aberrant response(s) to determine efficaciousness of the treatment or therapy and for selecting or modifying therapies and treatments that would be efficacious in treating, delaying the progression of or otherwise ameliorating a symptom.

The one or more COR homologs and/or microbes provided herein are useful for selecting a group of patients at a specific state of a disease with accuracy that facilitates selection of treatments.

The term "monitoring" generally refers to the follow-up of a disease or a condition in a subject for any changes which may occur over time.

The terms also encompass prediction of a disease. The terms "predicting" or "prediction" generally refer to an advance declaration, indication or foretelling of a disease or condition in a subject not (yet) having said disease or condition. For example, a prediction of a disease or condition in a subject may indicate a probability, chance or risk that the subject will develop said disease or condition, for example within a certain time period or by a certain age. Said probability, chance or risk may be indicated inter alia as an absolute value, range or statistics, or may be indicated relative to a suitable control subject or subject population (such as, e.g., relative to a general, normal or healthy subject or subject population). Hence, the probability, chance or risk that a subject will develop a disease or condition may be advantageously indicated as increased or decreased, or as fold-increased or fold-decreased relative to a suitable control subject or subject population. As used herein, the term "prediction" of the conditions or diseases as taught herein in a subject may also particularly mean that the subject has a 'positive' prediction of such, i.e., that the subject is at risk of having such (e.g., the risk is significantly increased vis-A-vis a control subject or subject population). The term "prediction of no" diseases or conditions as taught herein as described herein in a subject may particularly mean that the subject has a 'negative' prediction of such, i.e., that the subject's risk of having such is not significantly increased vis-à-vis a control subject or subject population.

For example, distinct reference values may represent the prediction of a risk (e.g., an abnormally elevated risk) of having a given disease or condition as taught herein vs. the prediction of no or normal risk of having said disease or condition. In another example, distinct reference values may represent predictions of differing degrees of risk of having such disease or condition.

In a further example, distinct reference values can represent the diagnosis of a given disease or condition as taught herein vs. the diagnosis of no such disease or condition (such as, e.g., the diagnosis of healthy, or recovered from said disease or condition, etc.). In another example, distinct reference values may represent the diagnosis of such disease or condition of varying severity.

In yet another example, distinct reference values may represent a good prognosis for a given disease or condition as taught herein vs. a poor prognosis for said disease or condition. In a further example, distinct reference values may represent varyingly favourable or unfavourable prognoses for such disease or condition.

Such comparison may generally include any means to determine the presence or absence of at least one difference and optionally of the size of such difference between values being compared. A comparison may include a visual inspection, an arithmetical or statistical comparison of measurements. Such statistical comparisons include, but are not limited to, applying a rule.

Reference values may be established according to known procedures previously employed. For example, a reference value may be established in an individual or a population of individuals characterised by a particular diagnosis, prediction and/or prognosis of said disease or condition (i.e., for whom said diagnosis, prediction and/or prognosis of the disease or condition holds true). Such population may comprise without limitation 2 or more, 10 or more, 100 or more, or even several hundred or more individuals.

A "deviation" of a first value from a second value may generally encompass any direction (e.g., increase: first value>second value; or decrease: first value<second value) and any extent of alteration.

For example, a deviation may encompass a decrease in a first value by, without limitation, at least about 10% (about 0.9-fold or less), or by at least about 20% (about 0.8-fold or less), or by at least about 30% (about 0.7-fold or less), or by at least about 40% (about 0.6-fold or less), or by at least about 50% (about 0.5-fold or less), or by at least about 60% (about 0.4-fold or less), or by at least about 70% (about 0.3-fold or less), or by at least about 80% (about 0.2-fold or less), or by at least about 90% (about 0.1-fold or less), relative to a second value with which a comparison is being made.

For example, a deviation may encompass an increase of a first value by, without limitation, at least about 10% (about 1.1-fold or more), or by at least about 20% (about 1.2-fold or more), or by at least about 30% (about 1.3-fold or more), or by at least about 40% (about 1.4-fold or more), or by at least about 50% (about 1.5-fold or more), or by at least about 60% (about 1.6-fold or more), or by at least about 70% (about 1.7-fold or more), or by at least about 80% (about 1.8-fold or more), or by at least about 90% (about 1.9-fold or more), or by at least about 100% (about 2-fold or more), or by at least about 150% (about 2.5-fold or more), or by at least about 200% (about 3-fold or more), or by at least about 500% (about 6-fold or more), or by at least about 700% (about 8-fold or more), or like, relative to a second value with which a comparison is being made.

Preferably, a deviation may refer to a statistically significant observed alteration. For example, a deviation may refer to an observed alteration which falls outside of error margins of reference values in a given population (as expressed, for example, by standard deviation or standard error, or by a predetermined multiple thereof, e.g., ±1×SD or ±2×SD or ±3×SD, or 1×SE or ±2×SE or ±3×SE). Deviation may also refer to a value falling outside of a reference range defined by values in a given population (for example, outside of a range which comprises ≥40%, ≥50%, ≥60%, ≥70%, ≥75% or ≥80% or ≥85% or ≥90% or ≥95% or even ≥100% of values in said population).

In a further embodiment, a deviation may be concluded if an observed alteration is beyond a given threshold or cut-off. Such threshold or cut-off may be selected as generally known in the art to provide for a chosen sensitivity and/or specificity of the prediction methods, e.g., sensitivity and/or specificity of at least 50%, or at least 60%, or at least 70%, or at least 80%, or at least 85%, or at least 90%, or at least 95%.

For example, receiver-operating characteristic (ROC) curve analysis can be used to select an optimal cut-off value of the quantity of a given immune cell population, biomarker or gene or gene product signatures, for clinical use of the present diagnostic tests, based on acceptable sensitivity and specificity, or related performance measures which are well-known per se, such as positive predictive value (PPV), negative predictive value (NPV), positive likelihood ratio (LR+), negative likelihood ratio (LR−), Youden index, or similar.

The present invention also may comprise a kit with a detection reagent that binds to one or more COR homologs and/or microbes, or biomarkers thereof.

Formulations

Agents described herein, including analogs thereof, and/or agents discovered to have medicinal value using the methods described herein are useful for administration in subject at risk or having conditions related to elevated cholesterol and/or inflammatory bowel disease. As used herein, the term "inflammatory bowel disease", includes, e.g., Crohn's disease (CD) and ulcerative colitis (UC). Elevated cholesterol can increase the risk of atherosclerosis, cardiovascular disease, peripheral arterial disease, transient ischemic attack, stroke, and heart attack. Elevated cholesterol may be measured as more than 200 mg/dL, more than 210 mg/dL, more than 220 mg/dL, more than 230 mg/dL, or more than 240 mg/dL, at or above 5.2 mmol/L, at or above 5.4 mmol/L, at or above 5.6 mmol/L, at or above 5.8 mmol/L, at or above 6.0 mmol/L, or at or above 6.2 mmol/L. Accordingly, agents described herein can be administered to subjects having, or at risk of, these conditions.

For therapeutic uses, the compositions or agents identified using the methods disclosed herein may be administered systemically, for example, formulated in a pharmaceutically-acceptable buffer such as physiological saline. Preferable routes of administration include, for example, subcutaneous, intravenous, interperitoneally, intramuscular, or intradermal injections that provide continuous, sustained levels of the drug in the patient. Treatment of human patients or other animals will be carried out using a therapeutically effective amount of a therapeutic identified herein in a physiologically-acceptable carrier. Suitable carriers and their formulation are described, for example, in Remington's Pharmaceutical Sciences by E. W. Martin. The amount of the therapeutic agent to be administered varies depending upon the manner of administration, the age and body weight of the patient, and with the clinical symptoms. Generally, amounts will be in the range of those used for other agents used in the treatment of other diseases associated with diabetes.

The disclosed compounds may be administered alone (e.g., in saline or buffer) or using any delivery vehicles known in the art. For instance the following delivery vehicles have been described: Cochleates; Emulsomes, ISCOMs; Liposomes; Live bacterial vectors (e.g., *Salmonella, Escherichia coli, Bacillus* calmette-guerin, *Shigella, Lactobacillus*); Live viral vectors (e.g., Vaccinia, adenovirus, Herpes Simplex); Microspheres; Nucleic acid vaccines; Polymers; Polymer rings; Proteasomes; Sodium Fluoride; Transgenic plants; Virosomes; Virus-like particles. Other delivery vehicles are known in the art and some additional examples are provided below.

The disclosed compounds may be administered by any route known, such as, for example, orally, transdermally, intravenously, cutaneously, subcutaneously, nasally, intramuscularly, intraperitoneally, intracranially, and intracerebroventricularly.

In certain embodiments, disclosed compounds are administered at dosage levels greater than about 0.001 mg/kg, such as greater than about 0.01 mg/kg or greater than about 0.1 mg/kg. For example, the dosage level may be from about 0.001 mg/kg to about 50 mg/kg such as from about 0.01 mg/kg to about 25 mg/kg, from about 0.1 mg/kg to about 10 mg/kg, or from about 1 mg/kg to about 5 mg/kg of subject body weight per day, one or more times a day, to obtain the desired therapeutic effect. It will also be appreciated that dosages smaller than about 0.001 mg/kg or greater than about 50 mg/kg (for example about 50-100 mg/kg) can also be administered to a subject.

In one embodiment, the compound is administered once-daily, twice-daily, or three-times daily. In one embodiment, the compound is administered continuously (i.e., every day) or intermittently (e.g., 3-5 days a week). In another embodiment, administration could be on an intermittent schedule.

Further, administration less frequently than daily, such as, for example, every other day may be chosen. In additional embodiments, administration with at least 2 days between doses may be chosen. By way of example only, dosing may be every third day, bi-weekly or weekly. As another example, a single, acute dose may be administered. Alternatively, compounds can be administered on a non-regular basis e.g., whenever symptoms begin. For any compound described herein the effective amount can be initially determined from animal models.

Toxicity and efficacy of the compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit large therapeutic indices may have a greater effect when practicing the methods as disclosed herein. While compounds that exhibit toxic side effects may be used, care should be taken to design a delivery system that targets such compounds to the site of affected tissue in order to minimize potential damage to uninfected cells and, thereby, reduce side effects.

Data obtained from the cell culture assays and animal studies can be used in formulating a range of dosage of the compounds disclosed herein for use in humans. The dosage of such agents lies within a range of circulating concentrations that include the ED50 with little or no toxicity. The dosage may vary within this range depending upon the dosage form employed and the route of administration utilized. For any compound used in the disclosed methods, the effective dose can be estimated initially from cell culture assays. A dose may be formulated in animal models to achieve a circulating plasma concentration range that includes the IC50 (i.e., the concentration of the test compound that achieves a half-maximal inhibition of symptoms) as determined in cell culture. Such information can be used to more accurately determine useful doses in humans. Levels in plasma may be measured, for example, by high performance liquid chromatography. In certain embodiments, pharmaceutical compositions may comprise, for example, at least about 0.1% of an active compound. In other embodiments, the active compound may comprise between about 2% to about 75% of the weight of the unit, or between about 25% to about 60%, for example, and any range derivable therein. Multiple doses of the compounds are also contemplated.

The formulations disclosed herein are administered in pharmaceutically acceptable solutions, which may routinely contain pharmaceutically acceptable concentrations of salt, buffering agents, preservatives, compatible carriers, and optionally other therapeutic ingredients.

For use in therapy, an effective amount of one or more disclosed compounds can be administered to a subject by any mode that delivers the compound(s) to the desired surface, e.g., mucosal, systemic. Administering the pharmaceutical composition of the present disclosure may be accomplished by any means known to the skilled artisan. Disclosed compounds may be administered orally, transdermally, intravenously, cutaneously, subcutaneously, nasally, intramuscularly, intraperitoneally, intracranially, or intracerebroventricularly.

For oral administration, one or more compounds can be formulated readily by combining the active compound(s) with pharmaceutically acceptable carriers well known in the art. Such carriers enable the compounds to be formulated as tablets, pills, dragees, capsules, liquids, gels, syrups, slurries, suspensions and the like, for oral ingestion by a subject to be treated. Pharmaceutical preparations for oral use can be obtained as solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate. Optionally the oral formulations may also be formulated in saline or buffers, i.e. EDTA for neutralizing internal acid conditions or may be administered without any carriers.

Also specifically contemplated are oral dosage forms of one or more disclosed compounds. The compound(s) may be chemically modified so that oral delivery of the derivative is efficacious. Generally, the chemical modification contemplated is the attachment of at least one moiety to the compound itself, where said moiety permits (a) inhibition of proteolysis; and (b) uptake into the blood stream from the stomach or intestine. Also desired is the increase in overall stability of the compound(s) and increase in circulation time in the body. Examples of such moieties include: polyethylene glycol, copolymers of ethylene glycol and propylene glycol, carboxymethyl cellulose, dextran, polyvinyl alcohol, polyvinyl pyrrolidone and polyproline. Other polymers that could be used are poly-1,3-dioxolane and poly-1,3,6-trioxocane. In some aspects for pharmaceutical usage, as indicated above, are polyethylene glycol moieties.

The location of release may be the stomach, the small intestine (the duodenum, the jejunum, or the ileum), or the large intestine. One skilled in the art has available formulations which will not dissolve in the stomach, yet will release the material in the duodenum or elsewhere in the intestine. In some aspects, the release will avoid the deleterious effects of the stomach environment, either by protection of the compound or by release of the biologically active material beyond the stomach environment, such as in the intestine.

To ensure full gastric resistance a coating impermeable to at least pH 5.0 is important. Examples of the more common inert ingredients that are used as enteric coatings are cellulose acetate trimellitate (CAT), hydroxypropylmethylcellulose phthalate (HPMCP), HPMCP 50, HPMCP 55, polyvinyl acetate phthalate (PVAP), Eudragit L30D, Aquateric, cellulose acetate phthalate (CAP), Eudragit L, Eudragit S, and Shellac. These coatings may be used as mixed films.

A coating or mixture of coatings can also be used on tablets, which are not intended for protection against the stomach. This can include sugar coatings, or coatings which make the tablet easier to swallow. Capsules may consist of a hard shell (such as gelatin) for delivery of dry therapeutic i.e. powder; for liquid forms, a soft gelatin shell may be used. The shell material of cachets could be thick starch or other edible paper. For pills, lozenges, molded tablets or tablet triturates, moist massing techniques can be used.

The disclosed compounds can be included in the formulation as fine multiparticulates in the form of granules or pellets of particle size about 1 mm. The formulation of the material for capsule administration could also be as a powder, lightly compressed plugs or even as tablets. The compound could be prepared by compression.

Colorants and flavoring agents may all be included. For example, the compound may be formulated (such as by liposome or microsphere encapsulation) and then further contained within an edible product, such as a refrigerated beverage containing colorants and flavoring agents.

One may dilute or increase the volume of compound delivered with an inert material. These diluents could include carbohydrates, especially mannitol, α-lactose, anhydrous lactose, cellulose, sucrose, modified dextrans and starch. Certain inorganic salts may be also be used as fillers including calcium triphosphate, magnesium carbonate and sodium chloride. Some commercially available diluents are Fast-Flo, Emdex, STA-Rx 1500, Emcompress and Avicell. Disintegrants may be included in the formulation of the therapeutic into a solid dosage form. Materials used as disintegrates include but are not limited to starch, including the commercial disintegrant based on starch, Explotab. Sodium starch glycolate, Amberlite, sodium carboxymethylcellulose, ultraamylopectin, sodium alginate, gelatin, orange peel, acid carboxymethyl cellulose, natural sponge and bentonite may all be used. Another form of the disintegrants is the insoluble cationic exchange resins. Powdered gums may be used as disintegrants and as binders and these can include powdered gums such as agar, Karaya or tragacanth. Alginic acid and its sodium salt are also useful as disintegrants.

Binders may be used to hold the therapeutic together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

An anti-frictional agent may be included in the formulation of the compound to prevent sticking during the formulation process. Lubricants may be used as a layer between the compound and the die wall, and these can include but are not limited to; stearic acid including its magnesium and calcium salts, polytetrafluoroethylene (PTFE), liquid paraffin, vegetable oils and waxes. Soluble lubricants may also be used such as sodium lauryl sulfate, magnesium lauryl sulfate, polyethylene glycol of various molecular weights, Carbowax 4000 and 6000. Glidants that might improve the flow properties of the drug during formulation and to aid rearrangement during compression might be added. The glidants may include starch, talc, pyrogenic silica and hydrated silicoaluminate.

To aid dissolution of the compound into the aqueous environment a surfactant might be added as a wetting agent. Surfactants may include anionic detergents such as sodium lauryl sulfate, dioctyl sodium sulfosuccinate and dioctyl sodium sulfonate. Cationic detergents might be used and could include benzalkonium chloride or benzethonium chloride. The list of potential non-ionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the compound either alone or as a mixture in different ratios.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. Microspheres formulated for oral administration may also be used. Such microspheres have been well defined in the art. All formulations for oral administration should be in dosages suitable for such administration.

For buccal administration, the compositions may take the form of tablets or lozenges formulated in conventional manner.

For administration by inhalation, the compounds for use according to the present disclosure may be conveniently delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of e.g. gelatin for use in an inhaler or insufflator may be formulated containing a powder mix of the compound and a suitable powder base such as lactose or starch.

Also contemplated herein is pulmonary delivery of the compounds of the disclosure. The compound is delivered to the lungs of a mammal while inhaling and traverses across the lung epithelial lining to the blood stream using methods well known in the art.

Contemplated for use in the practice of methods disclosed herein are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of these methods are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass.

All such devices require the use of formulations suitable for the dispensing of compound. Typically, each formulation is specific to the type of device employed and may involve the use of an appropriate propellant material, in addition to the usual diluents, and/or carriers useful in therapy. Also, the use of liposomes, microcapsules or microspheres, inclusion complexes, or other types of carriers is contemplated. Chemically modified compound may also be prepared in different formulations depending on the type of chemical modification or the type of device employed. Formulations suitable for use with a nebulizer, either jet or ultrasonic, will typically comprise compound dissolved in water at a concentration of about 0.1 to about 25 mg of biologically active compound per mL of solution. The formulation may also include a buffer and a simple sugar (e.g., for stabilization and regulation of osmotic pressure). The nebulizer formulation may also contain a surfactant, to reduce or prevent surface induced aggregation of the compound caused by atomization of the solution in forming the aerosol.

Formulations for use with a metered-dose inhaler device will generally comprise a finely divided powder containing the compound suspended in a propellant with the aid of a surfactant. The propellant may be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid may also be useful as a surfactant.

Formulations for dispensing from a powder inhaler device will comprise a finely divided dry powder containing compound and may also include a bulking agent, such as lactose, sorbitol, sucrose, or mannitol in amounts which facilitate dispersal of the powder from the device, e.g., about 50 to about 90% by weight of the formulation. The compound should most advantageously be prepared in particulate form with an average particle size of less than 10 mm (or microns), such as about 0.5 to about 5 mm, for an effective delivery to the distal lung.

Nasal delivery of a disclosed compound is also contemplated. Nasal delivery allows the passage of a compound to the blood stream directly after administering the therapeutic product to the nose, without the necessity for deposition of the product in the lung. Formulations for nasal delivery include those with dextran or cyclodextrin.

For nasal administration, a useful device is a small, hard bottle to which a metered dose sprayer is attached. In one embodiment, the metered dose is delivered by drawing the pharmaceutical composition solution into a chamber of defined volume, which chamber has an aperture dimensioned to aerosolize and aerosol formulation by forming a spray when a liquid in the chamber is compressed. The chamber is compressed to administer the pharmaceutical composition. In a specific embodiment, the chamber is a piston arrangement. Such devices are commercially available.

Alternatively, a plastic squeeze bottle with an aperture or opening dimensioned to aerosolize an aerosol formulation by forming a spray when squeezed is used. The opening is usually found in the top of the bottle, and the top is generally tapered to partially fit in the nasal passages for efficient administration of the aerosol formulation. In some aspects, the nasal inhaler will provide a metered amount of the aerosol formulation, for administration of a measured dose of the drug.

The compound, when it is desirable to deliver them systemically, may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in oily or aqueous vehicles, and may contain formulatory agents such as suspending, stabilizing and/or dispersing agents.

Pharmaceutical formulations for parenteral administration include aqueous solutions of the active compounds in water-soluble form. Additionally, suspensions of the active compounds may be prepared as appropriate oily injection suspensions.

Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Alternatively, the active compounds may be in powder form for constitution with a suitable vehicle, e.g., sterile pyrogen-free water, before use.

The compounds may also be formulated in rectal or vaginal compositions such as suppositories or retention enemas, e.g., containing conventional suppository bases such as cocoa butter or other glycerides.

In addition to the formulations described previously, the compounds may also be formulated as a depot preparation. Such long acting formulations may be formulated with suitable polymeric or hydrophobic materials (for example as an emulsion in an acceptable oil) or ion exchange resins, or as sparingly soluble derivatives, for example, as a sparingly soluble salt.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols.

Suitable liquid or solid pharmaceutical preparation forms are, for example, aqueous or saline solutions for inhalation, microencapsulated, encochleated, coated onto microscopic gold particles, contained in liposomes, nebulized, aerosols, pellets for implantation into the skin, or dried onto a sharp object to be scratched into the skin. The pharmaceutical compositions also include granules, powders, tablets, coated tablets, (micro)capsules, suppositories, syrups, emulsions, suspensions, creams, drops or preparations with protracted release of active compounds, in whose preparation excipients and additives and/or auxiliaries such as disintegrants, binders, coating agents, swelling agents, lubricants, flavorings, sweeteners or solubilizers are customarily used as described above. The pharmaceutical compositions are suitable for use in a variety of drug delivery systems.

The compounds may be administered per se (neat) or in the form of a pharmaceutically acceptable salt. When used in medicine the salts should be pharmaceutically acceptable, but non-pharmaceutically acceptable salts may conveniently be used to prepare pharmaceutically acceptable salts thereof. Such salts include, but are not limited to, those prepared from the following acids: hydrochloric, hydrobromic, sulphuric, nitric, phosphoric, maleic, acetic, salicylic, p-toluene sulphonic, tartaric, citric, methane sulphonic, formic, malonic, succinic, naphthalene-2-sulphonic, and benzene sulphonic. Also, such salts can be prepared as alkaline metal or alkaline earth salts, such as sodium, potassium or calcium salts of the carboxylic acid group.

Suitable buffering agents include: acetic acid and a salt (about 1-2% w/v); citric acid and a salt (about 1-3% w/v); boric acid and a salt (about 0.5-2.5% w/v); and phosphoric acid and a salt (about 0.8-2% w/v). Suitable preservatives include benzalkonium chloride (about 0.003-0.03% w/v); chlorobutanol (about 0.3-0.9% w/v); parabens (about 0.01-0.25% w/v) and thimerosal (about 0.004-0.02% w/v).

The pharmaceutical compositions contain an effective amount of a disclosed compound optionally included in a pharmaceutically acceptable carrier. The term pharmaceutically acceptable carrier means one or more compatible solid or liquid filler, diluents or encapsulating substances which are suitable for administration to a human or other vertebrate animal. The term carrier denotes an organic or inorganic ingredient, natural or synthetic, with which the active ingredient is combined to facilitate the application. The components of the pharmaceutical compositions also are capable of being commingled with the compounds, and with each other, in a manner such that there is no interaction which would substantially impair the desired pharmaceutical efficiency.
Pharmaceuticals Another aspect of the invention provides a composition, pharmaceutical composition or vaccine comprising microbes, coprostanol or derivatives thereof, or a combination thereof as taught herein.

A method of reducing cholesterol uptake in a subject, comprising delivering coprostanol or variant thereof in an effective amount to lower serum cholesterol in the subject. In embodiments, the coprostanol or variant thereof is provided in a water dispersible solid form, as described herein.

A "pharmaceutical composition" refers to a composition that usually contains an excipient, such as a pharmaceutically acceptable carrier that is conventional in the art and that is suitable for administration to cells or to a subject.

The term "pharmaceutically acceptable" as used throughout this specification is consistent with the art and means compatible with the other ingredients of a pharmaceutical composition and not deleterious to the recipient thereof.

As used herein, "carrier" or "excipient" includes any and all solvents, diluents, buffers (such as, e.g., neutral buffered saline or phosphate buffered saline), solubilisers, colloids, dispersion media, vehicles, fillers, chelating agents (such as, e.g., EDTA or glutathione), amino acids (such as, e.g., glycine), proteins, disintegrants, binders, lubricants, wetting agents, emulsifiers, sweeteners, colorants, flavourings, aromatisers, thickeners, agents for achieving a depot effect, coatings, antifungal agents, preservatives, stabilisers, antioxidants, tonicity controlling agents, absorption delaying agents, and the like. The use of such media and agents for pharmaceutical active components is well known in the art. Such materials should be non-toxic and should not interfere with the activity of the cells or active components.

Pharmaceutical formulations of microbes may comprise freshly thawed liquid microbial suspensions or refrigerated gelatin capsules filled with freeze-dried microbial biomass. enteric-coated gelatin capsules or buffers for delivery.

The precise nature of the carrier or excipient or other material will depend on the route of administration. For example, the composition may be in the form of a parenterally acceptable aqueous solution, which is pyrogen-free and has suitable pH, isotonicity and stability.

The pharmaceutical composition can be applied parenterally, rectally, orally or topically. Preferably, the pharmaceutical composition may be used for intravenous, intramuscular, subcutaneous, peritoneal, peridural, rectal, nasal, pulmonary, mucosal, or oral application. In a preferred embodiment, the pharmaceutical composition according to the invention is intended to be used as an infuse. The skilled person will understand that compositions which are to be administered orally or topically will usually not comprise cells, although it may be envisioned for oral compositions to also comprise cells, for example when gastro-intestinal tract indications are treated. Each of the cells or active components (e.g., modulants, immunomodulants, antigens) as discussed herein may be administered by the same route or may be administered by a different route. By means of example, and without limitation, cells may be administered parenterally and other active components may be administered orally.

Liquid pharmaceutical compositions may generally include a liquid carrier such as water or a pharmaceutically acceptable aqueous solution. For example, physiological saline solution, tissue or cell culture media, dextrose or other saccharide solution or glycols such as ethylene glycol, propylene glycol or polyethylene glycol may be included.

The composition may include one or more cell protective molecules, cell regenerative molecules, growth factors, anti-apoptotic factors or factors that regulate gene expression in the cells. Such substances may render the cells independent of their environment.

Such pharmaceutical compositions may contain further components ensuring the viability of the cells therein. For example, the compositions may comprise a suitable buffer system (e.g., phosphate or carbonate buffer system) to achieve desirable pH, more usually near neutral pH, and may comprise sufficient salt to ensure isoosmotic conditions for the cells to prevent osmotic stress. For example, suitable solution for these purposes may be phosphate-buffered saline (PBS), sodium chloride solution, Ringer's Injection or Lactated Ringer's Injection, as known in the art. Further, the composition may comprise a carrier protein, e.g., albumin (e.g., bovine or human albumin), which may increase the viability of the cells.

Further suitably pharmaceutically acceptable carriers or additives are well known to those skilled in the art and for instance may be selected from proteins such as collagen or gelatine, carbohydrates such as starch, polysaccharides, sugars (dextrose, glucose and sucrose), cellulose derivatives like sodium or calcium carboxymethylcellulose, hydroxypropyl cellulose or hydroxypropylmethyl cellulose, pregelatinized starches, pectin agar, carrageenan, clays, hydrophilic gums (acacia gum, guar gum, arabic gum and xanthan gum), alginic acid, alginates, hyaluronic acid, polyglycolic and polylactic acid, dextran, pectins, synthetic polymers such as water-soluble acrylic polymer or polyvinylpyrrolidone, proteoglycans, calcium phosphate and the like.

For example, microbial cells that have proliferated, or that are being differentiated in culture dishes, can be transferred onto three-dimensional solid supports in order to cause them to multiply and/or continue the differentiation process by incubating the solid support in a liquid nutrient medium of the invention, if necessary.

The microbes can be administered in a manner that permits them to survive, grow, and/or propagate and/or differentiate towards desired cell types (e.g. differentiation) or cell states. The cells or cell populations may be grafted to or may migrate to and engraft within the intended organ. In certain embodiments, a pharmaceutical cell preparation as taught herein may be administered in a form of liquid composition. In embodiments, the cells or pharmaceutical composition comprising such can be administered systemically, topically, within an organ or at a site of organ dysfunction or lesion.

Preferably, the pharmaceutical compositions may comprise a therapeutically effective amount of the specified microbes and/or other active components. The term "therapeutically effective amount" refers to an amount which can elicit a biological or medicinal response in a tissue, system, animal or human that is being sought by a researcher, veterinarian, medical doctor or other clinician, and in particular can prevent or alleviate one or more of the local or systemic symptoms or features of a disease or condition being treated.

The invention is further described in the following examples, which do not limit the scope of the invention described in the claims.

EXAMPLES

Example 1

Applicants describe herein the discovery of a widespread family of cholesterol oxidoreductase (COR) enzymes from a clade of uncultured gut bacteria. The presence of the cor genes in a microbiome predicts coprostanol presence in stool, and can be used as a biomarker for microbial coprostanol formation in the intestine, removing the need for fecal metabolomics measurements. By expanding our analysis to datasets with paired stool metagenomics and serum lipid measurements, Applicants have also shown that the presence of COR enzymes is significantly and positively associated with decreased total cholesterol and triglyceride levels in serum, linking the presence of this microbial metabolism with changes in serum lipid levels.

Figure 7:
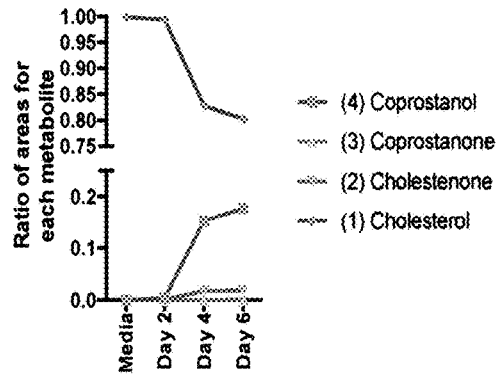
FIG. 7 Coprostanol formation by *Eubacterium coprostanoligenes* in pure culture. *E. coprostanoligenes* was cultured for 6 days in basal cholesterol media under anaerobic conditions at 37° C. At days 2, 4 and 6, samples were taken from the culture and levels of cholesterol and downstream metabolites were quantified using LC-MS.

The main group of bacteria reported to transform cholesterol to coprostanol were first isolated from the cecal contents of a rat in 1973, and are members of the genus *Eubacterium*. Bacteria with similar physical and biochemical characteristics, including the ability to generate coprostanol, have since been reported from a variety of different sources including rat, baboons and humans.[11-13] The only currently available strain from this group of organisms is *Eubacterium coprostanoligenes* HL (ATCC 51222), which was isolated from a hog sewage lagoon.[14] Applicants found that cultures of this strain converted cholesterol to coprostanol under previously published conditions (FIG. 7). Although additional studies have suggested that *Bacteroides dorei* and *Lactobacillus* species can also perform this transformation, Applicants did not observe coprostanol formation using a variety of *B. dorei* or *Lactobacillus* isolates (Table 3),[14-16] suggesting that this activity may be a strain-specific adaptation in this group of organisms.[17,18]

TABLE 3

Strains tested for coprostanol formation in monoculture

| Strain | Growth Condition 1 | Growth Condition 2 | Comments |
|---|---|---|---|
| *Bacteroides dorei* DIAB13 | Basal Cholesterol media | 1:1 (BHI Hemin Vitamin K:Basal Cholesterol media) | Grown anaerobically |
| *Bacteroides dorei* DIAB58 | Basal Cholesterol media | 1:1 (BHI Hemin Vitamin K:Basal Cholesterol media) | Grown anaerobically |
| *Bacteroides dorei* DIAB59 | Basal Cholesterol media | 1:1 (BHI Hemin Vitamin K:Basal Cholesterol media) | Grown anaerobically |
| *Bacteroides dorei* Novartis 291 | Basal Cholesterol media | 1:1 (BHI Hemin Vitamin K:Basal Cholesterol media) | Grown anaerobically |
| *Bacteroides dorei* Novartis 331 | Basal Cholesterol media | 1:1 (BHI Hemin Vitamin K:Basal Cholesterol media) | Grown anaerobically |
| *Bacteroides dorei* Novartis 631 | Basal Cholesterol media | 1:1 (BHI Hemin Vitamin K:Basal Cholesterol media) | Grown anaerobically |

TABLE 3-continued

Strains tested for coprostanol formation in monoculture

| Strain | Growth Condition 1 | Growth Condition 2 | Comments |
|---|---|---|---|
| Bacteroides dorei Novartis 662 | Basal Cholesterol media | 1:1 (BHI Hemin Vitamin K:Basal Cholesterol media) | Grown anaerobically |
| Bacteroides dorei Novartis 667 | Basal Cholesterol media | 1:1 (BHI Hemin Vitamin K:Basal Cholesterol media) | Grown anaerobically |
| Bifidobacterium longum ATCC 15697 | MRS medium with 0.15% (wt/vol) L_cysteine HCL with 100 uM cholesterol | 1:1 (MRS + Cysteine:Basal Cholesterol media) | Grown both anaerobically and aerobically |
| Bifidobacterium bifidum ATCC 29521 | MRS medium with 0.15% (wt/vol) L_cysteine HCL with 100 uM cholesterol | 1:1 (MRS + Cysteine:Basal Cholesterol media) | Grown both anaerobically and aerobically |
| Bifidobacterium catenalum ATCC 27539 | MRS medium with 0.15% (wt/vol) L_cysteine HCL with 100 uM cholesterol | 1:1 (MRS + Cysteine:Basal Cholesterol media) | Grown both anaerobically and aerobically |
| Bifidobacterium animalis ATCC 700541 | MRS medium with 0.15% (wt/vol) L_cysteine HCL with 100 uM cholesterol | 1:1 (MRS + Cysteine:Basal Cholesterol media) | Grown both anaerobically and aerobically |
| Bifidobacterium adolenscentis ATCC 15703 | MRS medium with 0.15% (wt/vol) L_cysteine HCL with 100 uM cholesterol | 1:1 (MRS + Cysteine:Basal Cholesterol media) | Grown both anaerobically and aerobically |
| Lactococcus lactis DIABIMMUNE Isolate DIAB158 | MRS medium with 0.15% (wt/vol) L_cysteine HCL with 100 uM cholesterol | 1:1 (MRS + Cysteine:Basal Cholesterol media) | Grown both anaerobically and aerobically |
| Lactobacillus crispatus | MRS medium with 0.15% (wt/vol) L_cysteine HCL with 100 uM cholesterol | 1:1 (MRS + Cysteine:Basal Cholesterol media) | Grown both anaerobically and aerobically |
| Lactobacillus gasseri DSM 20243 | MRS medium with 0.15% (wt/vol) L_cysteine HCL with 100 uM cholesterol | 1:1 (MRS + Cysteine:Basal Cholesterol media) | Grown both anaerobically and aerobically |
| Lactobacillus rhamnosus DIAMIMMUNE Isolate DIAB117 | MRS medium with 0.15% (wt/vol) L_cysteine HCL with 100 uM cholesterol | 1:1 (MRS + Cysteine:Basal Cholesterol media) | Grown both anaerobically and aerobically |
| Eubacterium coprostanoligenes | Basal Cholesterol media | | Grown anaerobically |
| Faecalibacterium prausnitzii ATCC 27766 | Basal Cholesterol media | 1:1 (BHI Hemin Vitamin K:Basal Cholesterol media) | Grown anaerobically |
| Coprococcus comes ATCC 27758 | Basal Cholesterol media | 1:1 (BHI Hemin Vitamin K:Basal Cholesterol media) | Grown anaerobically |
| Ruminoccus bromii ATCC 27255 | GAM plus 1% Glucose broth + 100 uM cholesterol | 1:1 (GAM plus 1% Glucose broth: Basal Cholesterol media) | Grown anaerobically |
| Clostridium leptum DSM753 | GAM plus 1% Glucose broth + 100 uM cholesterol | 1:1 (GAM plus 1% Glucose broth: Basal Cholesterol media) | Grown anaerobically |

Figure 9:
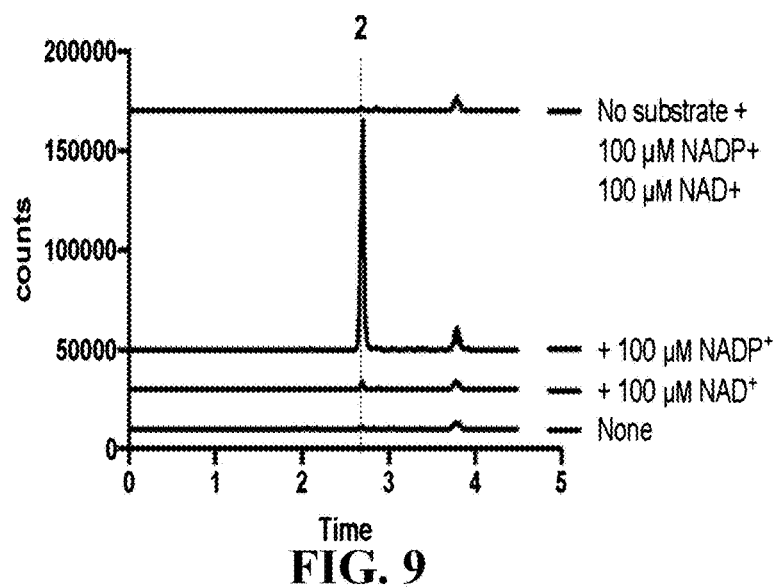
FIG. 9 Cholesterol oxidoreductase activity in *E. coprostanoligenes* lysate is $NADP^+$ dependent. Activity assay in *Eubacterium coprostanoligenes* lysate after growth for 2 days in media without cholesterol and lysis under anaerobic conditions. Conversion of cholesterol (100 μM) to cholestenone occurs in HEPES (pH=7.5, 300 mM NaCl) when $NADP^+$ (100 μM) is added to the lysate. Extracted ion chromatograms (EICs) of 2 (rt 2.60, 385.244→108.988) are shown for all conditions.

While the publicly available E. coprostanoligenes strain was isolated from a hog sewage lagoon, there is evidence that related strains are responsible for this transformation in humans.[19] Thus, Applicants used E. coprostanoligenes as a model to study the enzymes responsible for coprostanol formation. Applicants first incubated E. coprostanoligenes cell lysates with cholesterol (1) and observed the formation of cholestenone (2) in a NADP+-dependent manner (FIG. 1A, FIG. 9). This first step is concordant with published labeling studies in human stool and in pure cultures of E. coprostanoligenes suggesting the metabolism of cholesterol proceeds through an indirect reduction pathway involving the initial oxidation of cholesterol to cholestenone (2), followed by reduction of the Δ4,5-double bond to form coprostanone (3) and re-reduction of the ketone to generate coprostanol (FIG. 1A).[20,21] Feeding 2 and 3 to E. coprostanoligenes cultures resulted in coprostanol formation, further supporting their proposed roles as on-pathway intermediates.[20]

Figure 10:
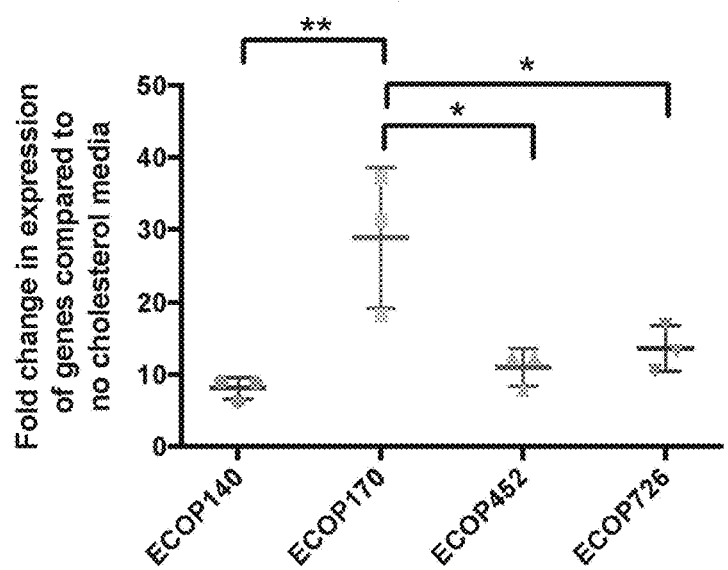
FIG. 10 ECOP170 is the HSD with the highest fold change in expression when grown on cholesterol containing medium compared to medium without cholesterol. The expression levels of the four genes encoding putative HSDs in *E. coprostanoligenes* when grown in cholesterol containing medium compared to medium without cholesterol at 48 h. Each point represents a biological replicate with the center bar representing the mean and error bars represent s.d. (n=3). P values were determined by one-way ANOVA followed by Tukey's multiple comparisons test.

To identify candidate enzymes for the conversion of cholesterol to 2, Applicants first searched the genome of E. coprostanoligenes for genes encoding homologs of known sterol metabolizing enzymes. As the gut is an anaerobic environment, Applicants reasoned that the well-studied oxygen-dependent cholesterol oxidases (PF09129) found in many Streptomyces species are unlikely to be responsible for mediating this transformation.[22] The only characterized, oxygen-independent enzyme capable of this reaction is AcmA (PF01370) from the soil bacterium Sterolibacterium denitrificans.[23] Unexpectedly, the E. coprostanoligenes genome did not harbor homologs of either class of enzymes. Another class of enzymes with the potential to perform the chemistry required for cholesterol oxidation is the hydroxysteroid dehydrogenases (HSDs), which belong to the short-chain dehydrogenase (SDR) enzyme family (PF00106). These enzymes are found in many gut microbes and can oxidize hydroxyl groups of bile acids to ketones in an oxygen-independent, NAD(P)+ dependent manner.[24] However, no characterized HSDs from the gut microbiota are known to accept cholesterol as a substrate. Using biochemically characterized HSDs from phylogenetically related gut microbes as a query, Applicants found four homologs of these enzymes encoded in the genome of E. coprostanoligenes (Table 4). Applicants expressed each of these putative HSDs in E. coli and evaluated the reactivity of cell lysates toward cholesterol (FIG. 1B). One of these proteins, ECOP170 (WP_078769004.1), oxidized cholesterol to 2, completing the first putative step in cholesterol metabolism by this organism. ECOP170 also catalyzed the oxidation of coprostanol (4) to coprostanone (3), suggesting it may be responsible for both the first (oxidation of cholesterol to cholestenone) and last (reduction of coprostanone to coprostanol) steps of this pathway (FIG. 1C). In order to further validate the role of ECOP170 in cholesterol metabolism, levels of the transcripts encoding all four HSDs were measured when *E. coprostanoligenes* was cultivated with and without cholesterol (FIG. 10, Table 5). Of these genes, ECOP170 had the largest increase in expression in medium containing cholesterol compared to media without cholesterol after 2 days of growth (28.9-fold increase). Furthermore, N-terminal $His_6$-tagged ECOP170 showed a dependence on $NADP^+$ and not $NAD^+$, which is in agreement with the activity Applicants observed in *E. coprostanoligenes* lysate (FIG. 11). Together, these data suggests that ECOP170 is the enzyme responsible for the oxidation of cholesterol to 2 in *E. coprostanoligenes*.

TABLE 4

Genes in *E. coprostanoligenes* with homology to known HSDs

| Target | NCBI Accession number | Nucleotide Sequence | Amino Acid Sequence |
|---|---|---|---|
| ECOP140 | WP_078768704.1 | ATGACACATGAAAATTTAAAGGGCAGGGTTGCCGTTGTT ACAGGCGGCGGCGGAGTCCTTTGCGGACAGTTTGCACA AACTCTTGCAAAGCAGGGCTGTAAGGTTGCCGTGCTTGA TTTGAACGAGGCAGCTGCACAGGCTTGTGCTGACGAAAT CGTTGCAAACGGCGGTGAGGCTATTGCAGTAGGTTGCA ATGTTCTTGACAGCGAATCAATGCAAAATGCAAGAAAAA TCATCAACGAAAAACTCGGCACTTGCGATATTCTTCTCAA TGGTGCAGGTGGCAATAATCCAAAGGGCACAACCACAA AGGACACTCTTGAGCAAATCGACCTTGTTCAAAAGGACG AGAATGTAAAGACCTTTTTCGACCTTGATGCAGACGGAA TTTCTTTTGTATTCAATCTCAACTTCCTCGGCACTCTTATTC CAACACAGGTTTTTGCAAGAGATATGGTGGAAAAAGAG CACGCTTGCATTGTTATGATAACTTCAATGAATGCGTTTA GACCGCTCACCCGTATCCTGCATATTCGGCTGCCAAAG CTGCGGTAAAGAACTTTACCGAATGGATGGCTGTTCACT TTGCACCAATGGGAATCAGAGTAAACGCAATCGCTCCGG GATTTTTCTCAACCAAGCAGAATGCAACACTTCTTTGGAA TGAGGACGGCACTCCGACCGCCCGTACAGGCAAAATCCT TGCCGCAACTCCAATGAATCGTTTTGGCGAGCCGGAGGA ACTTGACGGAACACTTCTGTTCCTTTGCGATGAGGCATAC AGCGGATTCATCACAGGCGTGAACATCCCTGTTGACGGA GGCTTCAACGCATACAGCGGAGTATAA (SEQ ID NO: 41) | MTHENLKGRVAVV TGGGGVLCGQFAQ TLAKQGCKVAVLDL NEAAAQACADEIVA NGGEAIAVGCNVLD SESMQNARKIINEKL GTCDILLNGAGGNN PKGTTTKDTLEQIDL VQKDENVKTFFDLD ADGISFVFNLNFLGT LIPTQVFARDMVEK EHACIVMITSMNAF RPLTRIPAYSAAKAA VKNFTEWMAVHFA PMGIRVNAIAPGFF STKQNATLLWNED GTPTARTGKILAATP MNRFGEPEELDGTL LFLCDEAYSGFITGV NIPVDGGFNAYSGV (SEQ ID NO: 42) |
| ECOP170 | WP_078769004.1 | ATGAGCACATGTTGGCTTCAAGGCAAGACTGTTGTTGTT ACCGGCGCTTCAGGCGGTATGGGTGCAGGCATTGCCGC AACTCTTATTAAAAAACACGGTTGTACTGTTATCGGTGTG GCAAGAAACGAAAAGAAAATGCTTAAGTTCGTTGATGA GCTTGGCGAAACTTATGCAAAGCAGTTTTCTTATGAGCTT TTTGATGTAAGTTCAAAAGAGAATTGGGAAAAATTTGCA GAGGAGCTTCAGGAAAAGGGCGTTAAGGTTGATGTTCT CATCAACAACGCAGGTATTCTTCCAAAGTTCAAGAGATTT GACAGATATTCTTATGAAGAAATCGAAAGAGCTATGAAC ATCAACTTCTACTCTTGCGTATATTCAGTTAAGACAATGT TGCCAATGCTTCTTCAGTCAAGCACACCGGCTATCATCAA TATTGACTCATCTGCTGCTCTTATGACACTTGCAGGCACA TCAATGTACTCTGCATCAAAGGCTGCACTTAAGGGCTTC ACAGAAGCACTTCGTGTTGAATTCCAAGGCAAGATGTTT GTTGGTCTTGTTTGCCCGGGCTTCACAAAGACAGACATTT TCTCCGGTCAGGGCGATGCTGATATGAGCAACGGCGCA AAGGTTATGGATATGATTTCAACCGACTGCGACAAGATG GTTAAAATGATTATGTTCGGCATTGAGCACAAGACACCT ATGCAGGTTCACGGTTTTGATGCACACGCAATGAGCGTT TTCAACCGCCTTATGCCTGTTTACGGCTCAAAGCTCTTCA GCTCAATTATGAGAATGTCAAATGTTGACATTTTCAAGG AAGTATTTTCTGATTAA (SEQ ID NO: 43) | MSTCWLQGKTVVV TGASGGMGAGIAA TLIKKHGCTVIGVAR NEKKMLKFVDELGE TYAKQFSYELFDVSS KENWEKFAEELQEK GVKVDVLINNAGILP KFKRFDRYSYEEIER AMNINFYSCVYSVK TMLPMLLQSSTPAII NIDSSAALMTLAGT SMYSASKAALKGFT EALRVEFQGKMFV GLVCPGFTKTDIFSG QGDADMSNGAKV MDMISTDCDKMVK MIMFGIEHKTPMQ VHGFDAHAMSVFN RLMPVYGSKLFSSI MRMSNVDIFKEVFS D (SEQ ID NO: 44) |
| ECOP452 | WP_078767936.1 | ATGGATAAAAAATTATTAGGAAAAGTAATAGTTGTATCC GGTGGAACAAAAGGTGTGGGACGTGCCGCATCCGAAGA ATTTGCTCGTCAGGGGGCAAAAGTTGTTATTGGTGGTAG AGATGAAGAATCTGCTTTAAAATCAATAAGAATTATGCG TACCTACGGTAGTGATGGTCTGTTTGTTCATACTGATTTG TTAAATATTGATGATTGTAAGAATCTTTTTGATAAAGCAT ACGAAAAGTTTGGAAGAATTGATGGCTTTTTCAACTATG CAGGTGTAACGCCTGTTTCTCCGCTTGATACTTGTGACGA AGACACATTTGATTGGGTTATGGATGTTAACTTCAAATCT TGTTTTTTCTGTTGTCAGCAAGCAATTAAATATATGCGTG AAAGTGGTGGAGGATCAATTGTTCTTACAGGCTCTGCTC ACGCATGGGGTGGGCAAAAGATAGAGCGGCTTATGCG TGTTCAAAAGGCGTGTTGTTGACTCTTATGGAGCATATT GCCCATAATTATGCTGTTGAGCAAATAAGGATGTAATTATT TGACTTTAGGCTGGACACCTACTGAAGGTGAAGTTAGTT TAAGAATATCACAAGGTGAGTCCGAAGCTGAATTGCGAC AAAGAGCATCCGATATCCTTCCTATGGGAAGAATGCTGG | MDKKLLGKVIVVSG GTKGVGRAASEEFA RQGAKVVIGGRDEE SALKSIRIMRTYGSD GLFVHTDLLNIDDCK NLFDKAYEKFGRID GFFNYAGVTPVSPL DTCDEDTFDWVMD VNFKSCFFCCQQAI KYMRESGGGSIVLT GSAHAWGGQKDR AAYACSKGVLLTLM EHIANNYAVEQIRC NYLTLGWTPTEGEV SLRISQGESEAELRQ RASDILPMGRMLER TDYLEGLVYLMSDS |

TABLE 4-continued

Genes in E. coprostanoligenes with homology to known HSDs

| Target | NCBI Accession number | Nucleotide Sequence | Amino Acid Sequence |
|---|---|---|---|
| | | AAAGAACTGATTATTTAGAAGGGTTAGTTTATTTGATGTC AGATTCTTCGTCGATGATGACTGGCTCGACATTCAGAATT ACAGCAGGAGAATATATTTGA (SEQ ID NO: 45) | SSMMTGSTFRITAG EYI (SEQ ID NO: 46) |
| ECOP726 | WP_078768913.1 | ATGAAAAAAGCATTAATAACAGGCGGTGCGACCGGAAT CGGCAAGGCAACCGCAATTTTGTTGCAACAAAACGGATA CGATGTGTACATCACATACAACCAAACAAAGCCGGACTA TGAAGTGAACGCAATAAAGTGCAATCTTGAAAATATTGA CGAAATCGAAAGTGCCGTTGAATCAATCGGCAGAGTTGA CCTACTTGTGAACAACGCAGGTGTGTCTATCATAAAAAT GATAAACGACATCACAGTCGAGGACTACGAAAAAATGA CCGCCGTGAACGAAAGAGCGGTGTATTTTGCAAGCAAGT TTTCTGCGTTGAAAATGATAAGAGAACAAAGCGGTGCGA TAATCAACATCAGTTCAATGTGGGGTCAGGTCGGTGCTT CGTGCGAAACCCTATATTCAATGACAAAGGCAGGAATCA TCGGGCTGACAAAGGCACTTGCAAAGGAACTTGCGCCA AGCAACATAACCGTGAATTGCATTGCACCGGGAATAATC GACACGAGAATGAACAATATGTTTGACGCCGAGGAATT GAAAGAAGAAGTGCCTCTCGGCAGGCTCGGAACTCCCG AAGAAATTGCACAGGCTGTGCTGTTTCTTGCAGAAAGTC CGTACATCACGGGTCAGATTTTAGGCGTCAACGGCGGA GCTATAATATAA (SEQ ID NO: 47) | MKKALITGGATGIG KATAILLQQNGYDV YITYNQTKPDYEVN AIKCNLENIDEIESAV ESIGRVDLLVNNAG VSIIKMINDITVEDYE KMTAVNERAVYFAS KFSALKMIREQSGAI INISSMWGQVGAS CETLYSMTKAGIIGL TKALAKELAPSNITV NCIAPGIIDTRMNN MFDAEELKEEVPLG RLGTPEEIAQAVLFL AESPYITGQILGVNG GAII (SEQ ID NO: 48) |

TABLE 5

Primers used to measure transcript level of 4 HSD genes in E. coprostanoligenes

| Target | Forward/ Reverse | Sequence | Efficiency from gDNA standard curve |
|---|---|---|---|
| 16S rRNA | F | GTGTGTAGCCCAGCACATAA (SEQ ID NO: 49) | 100.7 |
| | R | GCTACGCAAGAGCACTCTAAT (SEQ ID NO: 50) | |
| ECOP140 | F | GAGCACGCTTGCATTGTTATG (SEQ ID NO: 51) | 100.8 |
| | R | ACAGCCATCCATTCGGTAAAG (SEQ ID NO: 52) | |
| ECOP170 | F | GGGCTTCACAAAGACAGACA (SEQ ID NO: 53) | 99 |
| | R | GTGCTCAATGCCGAACATAATC (SEQ ID NO: 54) | |
| ECOP452 | F | GCATCCGATATCCTTCCTATGG (SEQ ID NO: 55) | 99.5 |
| | R | ATGTCGAGCCAGTCATCATC (SEQ ID NO: 56) | |
| ECOP726 | F | AAATCGAAAGTGCCGTTGAATC (SEQ ID NO: 57) | 101 |
| | R | CCTCGACTGTGATGTCGTTTAT (SEQ ID NO: 58) | |

Thermocycler conditions: 1) 50° C., 2:00 2) 95° C., 8:30 3) 95° C., 0:10 4) 60° C., 0:10 5) 72° C., 0:10 6) Go to 3, 39X Hypothesizing that related enzymes mediate this transformation in the human gut microbiome, Applicants searched the NCBI non-redundant protein database and identified 10 homologs of ECOP170 (>60% amino acid identity and 98-100% query coverage) (FIG. 1D). Interestingly, these homologs were only detected in co-abundant gene groups (CAGs), i.e. microbial species that lack cultured representatives and have only been identified in gut microbiome assemblies.[25] Since there are currently no available human gut microbial isolates encoding a homolog of the E. coprostanoligenes enzyme, Applicants tested the activities of ECOP170 homologs in vitro by heterologous expression in E. coli (Table 6, Table 7). All of the six ECOP170 homologs examined oxidized cholesterol to 2 in E. coli lysates (FIG. 1E, FIG. 12A-12B). Furthermore, ECOP170 and its human-associated homologs showed activity towards coprostanol but were unable to oxidize the primary bile acids cholic acid and chenodeoxycholic acid (FIG. 1E, FIG. 12A-12B). These data suggest that the human-associated homologs of ECOP170 enzymes are specifically involved in the first and last steps (FIG. 1A) of coprostanol biosynthesis in human gut microbiomes.

TABLE 6

Primers used to obtain cholesterol oxidoreductase genes of interest from stool samples

| CAG name | Sequence ID (from this study) | Forward/ Reverse | Sequence |
|---|---|---|---|
| CAG: 217 | >G104929_k105_ 46920_10 | F | GTTTAACTTTAAGAAGGAGATATACCATGTATT GTTGGTTAGACGG (SEQ ID NO: 59) |
| | | R | TTAGCAGCCGGATCTCATTACTCCGCCAGCTCG GCGT (SEQ ID NO: 60) |
| CAG: 251 | >ERR2017655_k103_ 67238_7 | F | GTTTAACTTTAAGAAGGAGATATACCATGAGTG ATTTTACTAAAGC (SEQ ID NO: 61) |
| | | R | TTAGCAGCCGGATCTCATTAATCATCAAACACT TCGC (SEQ ID NO: 62) |
| CAG: 341 | >ERR2017515_k79_ 109830_2 | F | GTTTAACTTTAAGAAGGAGATATACCATGAGTG ATTATACTAAAGC (SEQ ID NO: 63) |
| | | R | TTAGCAGCCGGATCTCATCAATCATCGAATACT TCGC (SEQ ID NO: 64) |

The primers contain adapters to pET28 plasmids for Gibson assembly. Sequences targeting the ORF are bolded.

TABLE 7A

Gene blocks ordered of codon optimized cholesterol oxidoreductase genes from metagenomic species using the pET28 vector.

| CAG name | Sequence ID | Sequence | Comments |
|---|---|---|---|
| CAG:180 | >ERR2017635_ k103_44512_ 154 | ATGGATCAGAATTGGATGAACAATACCACCGTGATCGTTACCGGCGCCA GCGGTGTATGGGCAAAGGCATCGCCGAATCTTTAATCGTGGACCACG GCTGCACCGTGATTGGCATCGCCCGCAGCGAGGAGAAAATGAAGAAGG TGGTGGAGGAGCTGGGCCCGAATGCCGAGAAGTTCAGCTACAAGCTGT TCGACGTGAGTGTGGAGCAGAACTGGATCGACTTCGCCAAGTATCTGG AGGACAACGACATCCACCCAGACATTTTAGTGAACAATGCGGGCATTTT ACCGAAGTTCGACCGCTTCGAACACTACAGCATGGCGGATATCGAAAAG GCGATGAACATCAACTTCTATAGCGCCGTGTACAGCATCCATACTTTACT GCCGATGATTTTAAAGAGCAAAACGCCGGGCATCATCAACATCGATAGC AGCGCCTCTTTAATGTCTTTAGCCGGTACGAGTGTGTACAGCGCCAGCA AAGCGGCTTTAAAATCTTTAAGCGAATCTTTACGCGAGGAACTCCGCGG TAAATGCTACGTGGGCATCGTTTGCCCGGGCTTCACCAAAACGGATATC TTCCGCAGCCAAGATGCGAGCGATGCCAAAGGCCAGAAAATGCTGAAC GCGGTGAGCACGAGCTGCGACCGCATGGTGAAAATGATCATGCACGAT ATCCGCACCCGCCGCCCACTGGGTGTGCATGGTTTCGATGCCGCCTTCAT GAACTACTTCGGTCGTTTAATGCCGGTGCTGGGCGGTCACATCTTCAGC AGCGTTATGAAAATCAGCAAACTGCCGCTGTTCGACCCGGTTTTCAAAG ATTAA (SEQ ID NO: 65) | Codon optimized |
| CAG:528 | >HSM67VEO_R_ k105_8042_1 | ACCGTGAACGTTGTGTACACCATCATCTACGGCGGCAAGCTGTTCATGA GCAACTGCTGGCTGAGTGGTAAAACTTGTGTTGTTACCGGTGCGAGCGG TGGTATGGGTGCCGGTATTGCGGCGACTTTAATCAAGAAGCACGGCTGC AAAGTGATCGGCGTTGCGCGCGCAGCGAACCGAAAATGAAAAAATTTATC GAAGAACTGGGCCCGACGTACGCCGAACAGTTCAGCTACAAGCTGTTCG ACGTGAGCAAGAACGAGAACTGGGTGAATTTCGCGCAAGAACTGAAAG ACGAGGGTGTGAAGATCGACGTTCTGGTGAACAACGCCGGCATTTTACC GAAATTCAAACGCTTCGACCGCTACGAGATGGACGAAATCGAAAAAGC GATTAATATTAATTTCTACAGCTGTGTGTACAGCATCAAAGCTTTACTGC CGATGTTATTAGAAAGCAACGACCCCGGTATTGTGAACATCGATAGCAG CGCCGCTTTAATGAGTCTCGCGGGTACCAGCATGTACAGCGCGAGCAAA GCGGCTTTAAAAGGCTTTACCGAAGCTTTACGCGAAGAATTCCGCGGCA AAATCTACGTTGGTTTAGTGTGCCCGGGCTTCACCAAGACCGACATTTTC CGCGATCAGAAAAACGATGGCGGCAAGGGCCAGAAAGTGATGGACAT GATCAGCACCGATTGCGATTTAATGGTGAAGATGATCATGTTCGGCATC GAACATAAACAAGCTTTACAGATCATGGCATGGATGCCCACGCGATGA GCGTGTTCGGCAAGCTGCTGCCGGTGAATGGTAGCCGTCTGTTCAGCGC CATCATGAAAGCCGCCGACATCGACCTCTTTAACGACGTGTTCCGCAACT AA (SEQ ID NO: 66) | Codon optimized- Contains Gibson adaptors |
| CAG:678 | >MSMA26AX_R_ k105_23254_2 | GTTTAACTTTAAGAAGGAGATATACCATGAGTAACTGGCTGGACGGTAA AACGTGCATCGTTACCGGTGCCAGCGGTGGTATGGGTGCCGGTATCGC GGCGACGCTGATTAAAAAGCACGGTTGCCGCGTGATCGGCATTGCCCG CAGCGAACCGAAGATGCTCAAGTTCATCGAGGAGCTGGGTCCGACCTAC GCGGAGCAGTTCAGCTACAAACTCTTCGATGTGAGCAAGAACGAAAATT GGGTGGATCTGGCGGCCGAACTCGAGAAGCAGAACATCCAAGTTGACG TGCTGGTTAACAACGCGGGCATCCTCCCGAAGTTCAAGCGTTTCGACCG CTACGACATGGACGAAATCGAGAAGGCGATCAATATTAACTTCTACAGC TGCGTGTACAGCATCAAGGCGCTGCTGCCGATGCTGATGAAAAGCAGC | Codon optimized- Contains Gibson adaptors |

TABLE 7A-continued

Gene blocks ordered of codon optimized cholesterol oxidoreductase genes from metagenomic species using the pET28 vector.

| CAG name | Sequence ID | Sequence | Comments |
|---|---|---|---|
| | | GATCCGGGCATCATCAACATCGATAGTAGCGCCGCGCTGATGAGTCTGG CGGGTACCAGTATGTACAGCGCGAGCAAAGCGGCGCTGAAGGGTTTCA CGGAAAGTCTGCGCGAGGAGTTTCGCGGCAAAGTTTACGTTGGTCTGGT GTGCCCGGGCTTTACCAAGACGGATATCTTCCGCGACCAGAAGAACGAT GGTGGCAAGGGTCAGAAGGTGATCAACATGATCAGCACCGACTGCGAT CTGATGGTGAAGCTGATCATGTTCGGCATCGAGCACAAGCAAGCGCTGC AAATCCACGGCGTGGATGCCCACGCCATGAACATCTTCGGCAAACTGCT GCCAGTGAACGGCAGCCGTCTGTTCAGTGCCGTTATGAAAGCCGCGGA CATCGATCTGTTCAGTGAGGTGTTCAAGGACTGAGATCCGGCTGCTAAC AAAGCCCG (SEQ ID NO: 67) | |

TABLE 7B

Mutagenesis of N-HIS tagged ECOP170 in pET28 vector

| S139A_ECOP170 | F | CGGCTATCATCAATAT TGACTCAGCTGCTGCT CTT (SEQ ID NO: 68) | E. coprostanoligenes | Paired with Muta2_R |
|---|---|---|---|---|
| S138A_ECOP170 | F | CGGCTATCATCAATAT TGACGCATCTGCTGCT CTT (SEQ ID NO: 69) | E. coprostanoligenes | Paired with Muta2_R |
| Muta2_R | R | GTCAATATTGATGATA GCCGGTGTGCTTGACT GAA (SEQ ID NO: 70) | E. coprostanoligenes | |
| Y160A_ECOP170 | F | CACTTGCAGGCACATC AATGGCCTCTGCATCA AAGGCTGCACTTA (SEQ ID NO: 71) | E. coprostanoligenes | Paired with Muta1_R |
| S163A_ECOP170 | F | CACTTGCAGGCACATC AATGTACTCTGCAGCA AAGGCTGCACTTA (SEQ ID NO: 72) | E. coprostanoligenes | Paired with Muta1_R |
| S161A_ECOP170 | F | CACTTGCAGGCACATC AATGTACGCTGCATCA AAGGCTGCACTTA (SEQ ID NO: 73) | E. coprostanoligenes | Paired with Muta1_R |
| K164A_ECOP170 | F | CACTTGCAGGCACATC AATGTACTCTGCATCA GCGGCTGCACTTA (SEQ ID NO: 74) | E. coprostanoligenes | Paired with Muta1_R |
| A162S_ECOP170 | F | CACTTGCAGGCACATC AATGTACTCTTCATCA AAGGCTGCACTTA (SEQ ID NO: 75) | E. coprostanoligenes | Paired with Muta1_R |
| Muta1_R | R | CATTGATGTGCCTGCA AGTGTCATAAGAGCAG CAGATGAGTC (SEQ ID NO: 76) | E. coprostanoligenes | |

TABLE 8

Protein sequences identifiers from the combined assembly that share at least 20% AA identity to ECOP170.

| >ERR2017606_k103_18959_5 (SEQ ID NO: 77) | >ERR2017468_k103_6496_2 (SEQ ID NO: 78) | >G72705_k105_69611_3 (SEQ ID NO: 79) | >G139994_k105_31550_2 (SEQ ID NO: 80) |
|---|---|---|---|
| >HSM5MD66_R_k105_22541_1 (SEQ ID NO: 81) | >CSM5MCUK_P_R_k105_ 30732_4 (SEQ ID NO: 82) | >ERR2017689_k103_58946_1 (SEQ ID NO: 83) | >G88909_k105_18215_34 (SEQ ID NO: 84) |

TABLE 8-continued

Protein sequences identifiers from the combined assembly that share at least 20% AA identity to ECOP170.

| | | | |
|---|---|---|---|
| >G72698_k105_10065_41 (SEQ ID NO: 85) | >MSM6J2LL_R_k105_35771_10 (SEQ ID NO: 86) | >ERR2017736_k103_29211_2 (SEQ ID NO: 87) | >ERR2017681_k103_2642_3 (SEQ ID NO: 88) |
| >G139962_k105_59841_2 (SEQ ID NO: 89) | >G141067_k105_5153_2 (SEQ ID NO: 90) | >G48820_k105_8566_54 (SEQ ID NO: 91) | >ERR2017685_k103_54893_9 I (SEQ ID NO: 92) |
| >G140887_k105_44653_5 (SEQ ID NO: 93) | >HSMA33KQ_R_k105_3667_2 (SEQ ID NO: 94) | >ERR2017614_k103_90584_2 (SEQ ID NO: 95) | >ERR2017719_k103_84431_2 (SEQ ID NO: 96) |
| >G89185_k105_33406_4 (SEQ ID NO: 97) | >CSM7KOLK_R_k105_38324_1 (SEQ ID NO: 98) | >ERR2017630_k103_4998_2 (SEQ ID NO: 99) | >ERR2017570_k103_37316_156 (SEQ ID NO: 100) |
| >G48817_k105_109935_2 (SEQ ID NO: 101) | >G140096_k105_16087_10 (SEQ ID NO: 102) | >ERR2017653_k103_21549_2 (SEQ ID NO: 103) | >G72694_k105_45049_13 (SEQ ID NO: 104) |
| >ERR2017703_k103_30121_38 (SEQ ID NO: 105) | >ERR2017458_k93_2794_2 (SEQ ID NO: 106) | >ERR2017631_k103_52150_12 (SEQ ID NO: 107) | >G48838_k105_115785_3 (SEQ ID NO: 108) |
| >G140139_k105_54286_26 (SEQ ID NO: 109) | >G72697_k105_88675_3 (SEQ ID NO: 110) | >ERR2017613_k103_17263_21 (SEQ ID NO: 111) | >G105056_k105_87698_2 (SEQ ID NO: 112) |
| >G140933_k105_12475_3 (SEQ ID NO: 113) | >G141131_k105_35049_9 (SEQ ID NO: 114) | >ERR2017589_k103_30004_2 (SEQ ID NO: 115) | >CSM5MCZ3_R_k105_2687_1 (SEQ ID NO: 116) |
| >G48812_k105_53130_1 (SEQ ID NO: 117) | >G140963_k105_66302_2 (SEQ ID NO: 118) | >ERR2017631_k103_43743_9 (SEQ ID NO: 119) | >ERR2017554_k103_7348_6 (SEQ ID NO: 120) |
| >G48802_k105_59965_8 (SEQ ID NO: 121) | >MSM5LLHG_P_R_k105_18354_11 (SEQ ID NO: 122) | >ERR2017631_k103_75292_2 (SEQ ID NO: 123) | >G36350_k105_31333_4 (SEQ ID NO: 124) |
| >ERR2017529_k103_44554_37 SEQ ID NO: 125) | >PSM7J17B_R_k105_1479_2 (SEQ ID NO: 126) | >ERR2017645_k103_53452_2 (SEQ ID NO: 127) | >G88745_k105_86553_4 (SEQ ID NO: 128) |
| >G88780_k105_30102_8 (SEQ ID NO: 129) | >G140839_k105_35220_4 (SEQ ID NO: 130) | >ERR2017615_k103_17583_4 (SEQ ID NO: 131) | >ERR2017605_k103_28752_5 (SEQ ID NO: 132) |
| >MSM79HAJ_R_k105_37312_4 (SEQ ID NO: 133) | >G141014_k105_19866_163 (SEQ ID NO: 134) | >ERR2017621_k103_14029_2 (SEQ ID NO: 135) | >G140046_k105_9728_57 (SEQ ID NO: 136) |
| >ERR2017633_k103_35117_2 (SEQ ID NO: 137) | >ERR2017454_k93_11122_1 (SEQ ID NO: 138) | >G36370_k105_6682_2 (SEQ ID NO: 139) | >CSMACTZP_R_k105_7189_1 (SEQ ID NO: 140) |
| >G72675_k105_11974_26 (SEQ ID NO: 141) | >G36352_k105_53533_16 (SEQ ID NO: 142) | >G141051_k105_53943_5 (SEQ ID NO: 143) | >PSM7J1C4_R_k105_34594_4 (SEQ ID NO: 144) |
| >CSM7KORK_R_k105_41575_13 (SEQ ID NO: 145) | >PSM7J14L_R_k105_3549_5 (SEQ ID NO: 146) | >G36380_k105_43646_24 (SEQ ID NO: 147) | >ERR2017682_k103_22302_10 (SEQ ID NO: 148) |
| >HSM5MD53_R_k105_19189_16 (SEQ ID NO: 149) | >G141056_k105_82494_6 (SEQ ID NO: 150) | >ERR2017543_k103_26347_9 (SEQ ID NO: 151) | >G140946_k105_81243_2 (SEQ ID NO: 152) |
| >G48820_k105_13922_236 (SEQ ID NO: 153) | >ERR2017554_k103_14928_2 (SEQ ID NO: 154) | >ERR2017531_k103_73850_3 (SEQ ID NO: 155) | >G72674_k105_50410_2 (SEQ ID NO: 156) |
| >CSM79HOZ_R_k105_49806_2 (SEQ ID NO: 157) | >ERR2017577_k103_95564_183 (SEQ ID NO: 158) | >G140037_k105_35216_1 (SEQ ID NO: 159) | >ERR2017434_k93_59901_7 (SEQ ID NO: 160) |
| >ERR2017552_k103_40643_2 (SEQ ID NO: 161) | >G89065_k105_33512_7 (SEQ ID NO: 162) | >ERR2017674_k103_17580_2 (SEQ ID NO: 163) | >G48838_k105_85766_11 (SEQ ID NO: 164) |
| >G105117_k105_47490_2 (SEQ ID NO: 165) | >ERR2017627_k103_3363_35 (SEQ ID NO: 166) | >G72698_k105_10036_22 (SEQ ID NO: 167) | >G140064_k105_36251_3 (SEQ ID NO: 168) |
| >ERR2017652_k103_132156_1 (SEQ ID NO: 169) | >HSMA33KS_R_k105_5109_4 (SEQ ID NO: 170) | >ERR2017639_k103_21150_3 (SEQ ID NO: 171) | >G141074_k105_87157_4 (SEQ ID NO: 172) |
| >PSM7J19R_R_k105_20839_1 (SEQ ID NO: 173) | >G105079_k105_46371_3 (SEQ ID NO: 174) | >ERR2017676_k103_30005_3 (SEQ ID NO: 175) | >ERR2017530_k103_41367_4 (SEQ ID NO: 176) |
| >G105094_k105_75363_1 (SEQ ID NO: 177) | >ERR2017658_k103_28160_2 (SEQ ID NO: 178) | >MSM79HBR_R_k105_7392_191 (SEQ ID NO: 179) | >G140037_k105_108806_1 (SEQ ID NO: 180) |
| >G141121_k105_45918_4 (SEQ ID NO: 181) | >G140964_k105_58498_9 (SEQ ID NO: 182) | >ERR2017638_k103_87961_2 (SEQ ID NO: 183) | >G104819_k105_57718_1 (SEQ ID NO: 184) |
| >G104876_k105_48921_2 (SEQ ID NO: 185) | >G140884_k105_48512_1 (SEQ ID NO: 186) | >ERR2017639_k103_30779_2 (SEQ ID NO: 187) | >ERR2017688_k103_79028_12 (SEQ ID NO: 188) |
| >ERR2017449_k93_76238_3 (SEQ ID NO: 189) | >ERR2017637_k103_34182_37 (SEQ ID NO: 190) | >G140812_k105_93116_3 (SEQ ID NO: 191) | >G141086_k105_13808_5 (SEQ ID NO: 192) |
| >G88971_k105_22187_3 (SEQ ID NO: 193) | >ERR2017482_k79_120774_45 (SEQ ID NO: 194) | >ERR2017643_k103_31501_2 (SEQ ID NO: 195) | >G140990_k105_23667_1 (SEQ ID NO: 196) |
| >G48783_k105_4609_58 (SEQ ID NO: 197) | >G140785_k105_4188_1 (SEQ ID NO: 198) | >G140194_k105_52711_1 (SEQ ID NO: 199) | >ERR2017568_k103_24746_3 (SEQ ID NO: 200) |
| >ERR2017546_k103_48458_17 (SEQ ID NO: 201) | >G141087_k105_37700_1 (SEQ ID NO: 202) | >ERR2017462_k103_105205_9 (SEQ ID NO: 203) | >G139981_k105_41444_2 (SEQ ID NO: 204) |
| >CSM7KOS7_R_k105_27908_15 (SEQ ID NO: 205) | >G139992_k105_44197_6 (SEQ ID NO: 206) | >ERR2017576_k103_55329_31 (SEQ ID NO: 207) | >ERR2017667_k103_86069_9 (SEQ ID NO: 208) |
| >ERR2017651_k103_23084_12 (SEQ ID NO: 209) | >ERR2017564_k103_39580_13 (SEQ ID NO: 210) | >ERR2017639_k103_11789_18 (SEQ ID NO: 211) | >ERR2017530_k103_89168_1 (SEQ ID NO: 212) |
| >ERR2017596_k103_15764_10 (SEQ ID NO: 213) | >ERR2017549_k103_72053_5 (SEQ ID NO: 214) | >ERR2017579_k103_39438_3 (SEQ ID NO: 215) | >G140100_k105_63976_4 (SEQ ID NO: 216) |
| >ERR2017519_k103_66316_3 (SEQ ID NO: 217) | >G140887_k105_14976_1 (SEQ ID NO: 218) | >ERR2017726_k103_56_15 (SEQ ID NO: 219) | >ERR2017604_k103_15448_7 (SEQ ID NO: 220) |
| >G48791_k105_153014_9 (SEQ ID NO: 221) | >G48798_k105_61937_1 (SEQ ID NO: 222) | >G72710_k105_2519_4 (SEQ ID NO: 223) | >G141047_k105_104615_3 (SEQ ID NO: 224) |
| >G105079_k105_29139_2 (SEQ ID NO: 225) | >PSM7J14L_R_k105_1274_57 (SEQ ID NO: 226) | >G141050_k105_12742_2 (SEQ ID NO: 227) | >G141111_k105_50887_3 (SEQ ID NO: 228) |
| >ERR2017674_k103_16236_43 (SEQ ID NO: 229) | >G88869_k105_4784_2 (SEQ ID NO: 230) | >G48807_k105_51508_2 (SEQ ID NO: 231) | >G72689_k105_14628_1 (SEQ ID NO: 232) |

TABLE 8-continued

Protein sequences identifiers from the combined assembly that share at least 20% AA identity to ECOP170.

| | | | |
|---|---|---|---|
| >G36355_k105_53467_2 (SEQ ID NO: 233) | >G36387_k105_944_1 (SEQ ID NO: 234) | >ERR2017650_k103_39143_6 (SEQ ID NO: 235) | >PSM7J161_R_k105_6805_14 (SEQ ID NO: 236) |
| >G140856_k105_85477_17 (SEQ ID NO: 237) | >G105092_k105_29528_1 (SEQ ID NO: 238) | >ERR2017700_k103_20170_20 (SEQ ID NO: 239) | >HSM7CYX8_R_k105_9231_1 (SEQ ID NO: 240) |
| >G140887_k105_41000_3 (SEQ ID NO: 241) | >G104871_k105_29408_2 (SEQ ID NO: 242) | >G72676_k105_40564_3 (SEQ ID NO: 243) | >G140878_k105_42061_6 (SEQ ID NO: 244) |
| >G140839_k105_38876_2 (SEQ ID NO: 245) | >G140996_k105_18907_1 (SEQ ID NO: 246) | >ERR2017598_k103_20101_4 (SEQ ID NO: 247) | >G36356_k105_13466_28 (SEQ ID NO: 248) |
| >G72708_k105_9332_30 (SEQ ID NO: 249) | >ERR2017592_k103_37689_4 (SEQ ID NO: 250) | >ERR2017631_k103_8485_8 (SEQ ID NO: 251) | >G140016_k105_3400_2 (SEQ ID NO: 252) |
| >ERR2017700_k103_958_15 (SEQ ID NO: 253) | >G72724_k105_78628_64 (SEQ ID NO: 254) | >G104908_k105_22979_1 (SEQ ID NO: 255) | >G139967_k105_11935_5 (SEQ ID NO: 256) |
| >CSM67UAA_R_k105_11802_63 (SEQ ID NO: 257) | >ERR2017575_k103_85655_2 (SEQ ID NO: 258) | >ERR2017715_k103_13231_3 (SEQ ID NO: 259) | >MSM79H81_R_k105_297_2 (SEQ ID NO: 260) |
| >G141011_k105_467_27 (SEQ ID NO: 261) | >ERR2017460_k93_16182_3 (SEQ ID NO: 262) | >G139998_k105_34320_1 (SEQ ID NO: 263) | >G89089_k105_38776_4 (SEQ ID NO: 264) |
| >G139957_k105_59731_160 (SEQ ID NO: 265) | >G48780_k105_3277_39 (SEQ ID NO: 266) | >G72731_k105_38163_7 (SEQ ID NO: 267) | >G72690_k105_124636_5 (SEQ ID NO: 268) |
| >G140845_k105_90412_3 (SEQ ID NO: 269) | >G88977_k105_29795_4 (SEQ ID NO: 270) | >G36361_k105_7437_2 (SEQ ID NO: 271) | >G88725_k105_49824_3 (SEQ ID NO: 272) |
| >G48822_k105_6243_3 (SEQ ID NO: 273) | >G141126_k105_22068_1 (SEQ ID NO: 274) | >G141001_k105_25796_34 (SEQ ID NO: 275) | >CSM79HN2_R_k105_79021_36 (SEQ ID NO: 276) |
| >ERR2017696_k103_26704_7 (SEQ ID NO: 277) | >ERR2017693_k103_2028_5 (SEQ ID NO: 278) | >G140766_k105_89589_11 (SEQ ID NO: 279) | >G105037_k105_8994_1 (SEQ ID NO: 280) |
| >G72694_k105_57124_26 (SEQ ID NO: 281) | >G140012_k105_92516_3 (SEQ ID NO: 282) | >G104898_k105_28751_2 (SEQ ID NO: 283) | >G105040_k105_71789_8 (SEQ ID NO: 284) |
| >G139982_k105_54160_2 (SEQ ID NO: 285) | >G140130_k105_2894_2 (SEQ ID NO: 286) | >G140853_k105_22848_7 (SEQ ID NO: 287) | >ERR2017729_k103_26930_17 (SEQ ID NO: 288) |
| >G140799_k105_74553_5 (SEQ ID NO: 289) | >G48820_k105_10791_11 (SEQ ID NO: 290) | >G48820_k105_6957_2 (SEQ ID NO: 291) | >HSM67VFX_P_R_k105_42292_1 (SEQ ID NO: 292) |
| >G48841_k105_1396_8 (SEQ ID NO: 293) | >G140117_k105_28751_140 (SEQ ID NO: 294) | >ERR2017579_k103_120694_3 (SEQ ID NO: 295) | >ERR2017491_k103_92668_8 (SEQ ID NO: 296) |
| >ERR2017617_k103_41720_5 (SEQ ID NO: 297) | >G140946_k105_73316_8 (SEQ ID NO: 298) | >ERR2017614_k103_125466_62 (SEQ ID NO: 299) | >ERR2017542_k103_45310_9 (SEQ ID NO: 300) |
| >G48817_k105_185451_55 (SEQ ID NO: 301) | >G48832_k105_14987_2 (SEQ ID NO: 302) | >ERR2017545_k103_66522_9 (SEQ ID NO: 303) | >G72709_k105_49303_2 (SEQ ID NO: 304) |
| >G140963_k105_3708_2 (SEQ ID NO: 305) | >ERR2017697_k103_1288_2 (SEQ ID NO: 306) | >G72716_k105_58865_1 (SEQ ID NO: 307) | >G48817_k105_2987_2 (SEQ ID NO: 308) |
| >ERR2017686_k103_5648_20 (SEQ ID NO: 309) | >G141049_k105_10944_7 (SEQ ID NO: 310) | >ERR2017621_k103_13678_2 (SEQ ID NO: 311) | >G48784_k105_9944_8 (SEQ ID NO: 312) |
| >CSM5MCXB_P_R_k105_12902_1 (SEQ ID NO: 313) | >G72705_k105_82220_6 (SEQ ID NO: 314) | >G36370_k105_15464_32 (SEQ ID NO: 315) | >G105114_k105_85635_12 (SEQ ID NO: 316) |
| >ERR2017587_k103_55676_25 (SEQ ID NO: 317) | >HSMA33KS_R_k105_9141_3 (SEQ ID NO: 318) | >G48820_k105_8920_170 (SEQ ID NO: 319) | >G140023_k105_7679_2 (SEQ ID NO: 320) |
| >G141040_k105_13163_2 (SEQ ID NO: 321) | >G140042_k105_13126_4 (SEQ ID NO: 322) | >ERR2017726_k103_17011_38 (SEQ ID NO: 323) | >G140771_k105_40685_1 (SEQ ID NO: 324) |
| >G36367_k105_2698_2 (SEQ ID NO: 325) | >ERR2017543_k103_52586_15 (SEQ ID NO: 326) | >G140174_k105_28629_4 (SEQ ID NO: 327) | >ERR2017729_k103_10463_4 (SEQ ID NO: 328) |
| >G36356_k105_43864_15 (SEQ ID NO: 329) | >ERR2017617_k103_19201_14 (SEQ ID NO: 330) | >ERR2017639_k103_25741_2 (SEQ ID NO: 331) | >ERR2017716_k103_2675_95 (SEQ ID NO: 332) |
| >G105090_k105_15529_94 (SEQ ID NO: 333) | >CSM5MCZD_R_k105_14716_4 (SEQ ID NO: 334) | >ERR2017631_k103_28158_10 (SEQ ID NO: 335) | >ERR2017579_k103_16935_19 (SEQ ID NO: 336) |
| >G36387_k105_8183_4 (SEQ ID NO: 337) | >CSM67UAA_R_k105_7607_70 (SEQ ID NO: 338) | >G140867_k105_3347_4 (SEQ ID NO: 339) | >CSM5MCYS_R_k105_36307_2 (SEQ ID NO: 340) |
| >ERR2017581_k103_23882_1 (SEQ ID NO: 341) | >G140017_k105_63911_2 (SEQ ID NO: 342) | >ERR2017665_k103_38533_6 (SEQ ID NO: 343) | >G48814_k105_29432_3 (SEQ ID NO: 344) |
| >MSM9VZLN_R_k105_75483_2 (SEQ ID NO: 345) | >ERR2017641_k103_42292_126 (SEQ ID NO: 346) | >ESM5MEB7_R_k105_43306_5 (SEQ ID NO: 347) | >G48780_k105_45296_49 (SEQ ID NO: 348) |
| >G36385_k105_789_3 (SEQ ID NO: 349) | >ERR2017697_k103_62379_7 (SEQ ID NO: 350) | >ERR2017681_k103_28529_33 (SEQ ID NO: 351) | >G104851_k105_21388_32 (SEQ ID NO: 352) |
| >G139999_k105_27221_4 (SEQ ID NO: 353) | >G140088_k105_77842_12 (SEQ ID NO: 354) | >G141818_k105_41977_5 (SEQ ID NO: 355) | >ERR2017467_k103_57239_53 (SEQ ID NO: 356) |
| >G88934_k105_4632_1 (SEQ ID NO: 357) | >ERR2017674_k103_16808_6 (SEQ ID NO: 358) | >ERR2017519_k103_29366_2 (SEQ ID NO: 359) | >G140776_k105_27903_2 (SEQ ID NO: 360) |
| >G48840_k105_54194_2 (SEQ ID NO: 361) | >G141126_k105_78436_9 (SEQ ID NO: 362) | >G48812_k105_25551_2 (SEQ ID NO: 363) | >G88975_k105_91712_4 (SEQ ID NO: 364) |
| >G72726_k105_10981_53 (SEQ ID NO: 365) | >G140043_k105_39728_24 (SEQ ID NO: 366) | >ERR2017605_k103_21352_6 (SEQ ID NO: 367) | >G140753_k105_21915_5 (SEQ ID NO: 368) |
| >G88786_k105_57521_17 (SEQ ID NO: 369) | >ERR2017570_k103_50999_3 (SEQ ID NO: 370) | >G139992_k105_29244_74 (SEQ ID NO: 371) | >ERR2017519_k103_30088_1 (SEQ ID NO: 372) |
| >ERR2017732_k103_18278_4 (SEQ ID NO: 373) | >G48823_k105_79555_27 (SEQ ID NO: 374) | >G36371_k105_20134_2 (SEQ ID NO: 375) | >ERR2017649_k103_96852_2 (SEQ ID NO: 376) |
| >G48784_k105_81628_2 (SEQ ID NO: 377) | >G36396_k105_1379_3 (SEQ ID NO: 378) | >ERR2017645_k103_31037_6 (SEQ ID NO: 379) | >G140770_k105_36016_5 (SEQ ID NO: 380) |

TABLE 8-continued

Protein sequences identifiers from the combined assembly that share at least 20% AA identity to ECOP170.

| | | | |
|---|---|---|---|
| >ERR2017643_k103_29169_2 | >ERR2017613_k103_23170_12 | >HSM5MD4B_P_R_k105_11944_2 | >G88744_k105_24353_3 |
| (SEQ ID NO: 381) | (SEQ ID NO: 382) | (SEQ ID NO: 383) | (SEQ ID NO: 384) |
| >ERR2017678_k103_13064_34 | >G72705_k105_88413_9 | >MSM9VZHF_R_k105_24116_10 | >G48786_k105_9077_12 |
| (SEQ ID NO: 385) | (SEQ ID NO: 386) | (SEQ ID NO: 387) | (SEQ ID NO: 388) |
| >G48784_k105_52712_3 | >CSM5MCV1_P_R_k105_8313_1 | >HSM5MD53_R_k105_11106_11 | >MSM79HBR_R_k105_15956_1 |
| (SEQ ID NO: 389) | (SEQ ID NO: 390) | (SEQ ID NO: 391) | (SEQ ID NO: 392) |
| >G48780_k105_59164_29 | >G72711_k105_8997_61 | >G104914_k105_101352_13 | >ERR2017634_k103_18448_9 |
| (SEQ ID NO: 393) | (SEQ ID NO: 394) | (SEQ ID NO: 395) | (SEQ ID NO: 396) |
| >G140038_k105_8824_4 | >G88951_k105_394_1 | >ERR2017482_k79_94078_13 | >CSM7KOS7_R_k105_38487_2 |
| (SEQ ID NO: 397) | (SEQ ID NO: 398) | (SEQ ID NO: 399) | (SEQ ID NO: 400) |
| >ERR2017725_k103_33716_23 | >G36363_k105_7228_13 | >ERR2017466_k103_22863_3 | >ERR2017637_k103_58392_1 |
| (SEQ ID NO: 401) | (SEQ ID NO: 402) | (SEQ ID NO: 403) | (SEQ ID NO: 404) |
| >G89094_k105_2233_3 | >ERR2017647_k103_35937_27 | >G88903_k105_28222_11 | >G105057_k105_67836_12 |
| (SEQ ID NO: 405) | (SEQ ID NO: 406) | (SEQ ID NO: 407) | (SEQ ID NO: 408) |
| >G89181_k105_10605_13 | >PSM7J14L_R_k10_788_2 | >G104948_k105_50358_2 | >ERR2017521_k103_127408_11 |
| (SEQ ID NO: 409) | (SEQ ID NO: 410) | (SEQ ID NO: 411) | (SEQ ID NO: 412) |
| >G140176_k105_5182_9 | >G48804_k105_10132_2 | >G48821_k105_905_64 | >G140796_k105_16048_2 |
| (SEQ ID NO: 413) | (SEQ ID NO: 414) | (SEQ ID NO: 415) | (SEQ ID NO: 416) |
| >HSM5MD6M_R_k105_982_5 | >ERR2017637_k103_26213_3 | >G48806_k105_17989_2 | >G105030_k105_45566_1 |
| (SEQ ID NO: 417) | (SEQ ID NO: 418) | (SEQ ID NO: 419) | (SEQ ID NO: 420) |
| >G140157_k105_13446_55 | >G89065_k105_45479_46 | >ERR2017646_k103_86310_2 | >ERR2017619_k103_28417_9 |
| (SEQ ID NO: 421) | (SEQ ID NO: 422) | (SEQ ID NO: 423) | (SEQ ID NO: 424) |
| >ERR2017655_k103_67238_7 | >G48836_k105_4249_254 | >PSMA2668_R_k105_15422_6 | >ERR2017686_k103_15973_13 |
| (SEQ ID NO: 425) | (SEQ ID NO: 426) | (SEQ ID NO: 427) | (SEQ ID NO: 428) |
| >ERR2017515_k79_109830_2 | >ERR2017461_k103_26273_2 | >G140884_k105_31816_4 | >G105031_k105_28514_2 |
| (SEQ ID NO: 429) | (SEQ ID NO: 430) | (SEQ ID NO: 431) | (SEQ ID NO: 432) |
| >ERR2017598_k103_131885_26 | >G48812_k105_95414_5 | >ERR2017631_k103_9179_2 | >G141037_k105_61614_10 |
| (SEQ ID NO: 433) | (SEQ ID NO: 434) | (SEQ ID NO: 435) | (SEQ ID NO: 436) |
| >G139971_k105_23554_2 | >G48806_k105_15212_1 | >ERR2017646_k103_40362_2 | >ERR2017714_k103_34019_6 |
| (SEQ ID NO: 437) | (SEQ ID NO: 438) | (SEQ ID NO: 439) | (SEQ ID NO: 440) |
| >G48791_k105_70309_15 | >ERR2017659_k103_28782_2 | >G141111_k105_5045_1 | >ERR2017634_k103_26420_71 |
| (SEQ ID NO: 441) | (SEQ ID NO: 442) | (SEQ ID NO: 443) | (SEQ ID NO: 444) |
| >ERR2017579_k103_124057_15 | >ERR2017688_k103_105652_4 | >G140138_k105_1098_1 | >ERR2017546_k103_13609_34 |
| (SEQ ID NO: 445) | (SEQ ID NO: 446) | (SEQ ID NO: 447) | (SEQ ID NO: 448) |
| >G141120_k105_23294_2 | >HSMA33KS_R_k105_43252_2 | >ERR2017698_k103_49777_6 | >HSM6XRQB_P_R_k105_41921_5 |
| (SEQ ID NO: 449) | (SEQ ID NO: 450) | (SEQ ID NO: 451) | (SEQ ID NO: 452) |
| >G89065_k105_134985_11 | >G139991_k105_65923_20 | >G36347_k10_4358_97 | >ERR2017630_k103_27421_2 |
| (SEQ ID NO: 453) | (SEQ ID NO: 454) | (SEQ ID NO: 455) | (SEQ ID NO: 456) |
| >G89074_k105_22024_1 | >CSM5MCUC_P_R_k105_28589_3 | >G140126_k105_56160_25 | >ERR2017636_k103_14328_5 |
| (SEQ ID NO: 457) | (SEQ ID NO: 458) | (SEQ ID NO: 459) | (SEQ ID NO: 460) |
| >ERR2017462_k103_45511_1 | >CSM67UEI_R_k105_6374_31 | >G8906_k105_44762_8 | >G104817_k105_46932_2 |
| (SEQ ID NO: 461) | (SEQ ID NO: 462) | (SEQ ID NO: 463) | (SEQ ID NO: 464) |
| >G89019_k105_14772_6 | >G36392_k105_20560_5 | >ERR2017627_k103_5191_9 | >ERR2017627_k103_567_1 |
| (SEQ ID NO: 465) | (SEQ ID NO: 466) | (SEQ ID NO: 467) | (SEQ ID NO: 468) |
| >CSM79HGV_P_R_k105_38368_7 | >G141060_k105_19626_5 | >G140911_k105_458_16 | >G89268_k105_36439_3 |
| (SEQ ID NO: 469) | (SEQ ID NO: 470) | (SEQ ID NO: 471) | (SEQ ID NO: 472) |
| >G104980_k105_42184_2 | >ERR2017696_k103_15968_7 | >PSM7J1BP_R_k105_3311_3 | >MSM79HC8_R_k105_52475_11 |
| (SEQ ID NO: 473) | (SEQ ID NO: 474) | (SEQ ID NO: 475) | (SEQ ID NO: 476) |
| >G104929_k105_46920_10 | >G140758_k105_38294_2 | >ERR2017604_k103_9572_2 | >G139969_k105_67207_2 |
| (SEQ ID NO: 477) | (SEQ ID NO: 478) | (SEQ ID NO: 479) | (SEQ ID NO: 480) |
| >ERR2017540_k103_8816_2 | >G36347_k105_17334_2 | >MSMAPC64_R_k105_30838_3 | >ERR2017631_k103_46747_36 |
| (SEQ ID NO: 481) | (SEQ ID NO: 482) | (SEQ ID NO: 483) | (SEQ ID NO: 484) |
| >ERR2017697_k103_52134_11 | >G48817_k105_52454_2 | >ERR2017637_k103_19638_30 | >G140040_k105_32777_2 |
| (SEQ ID NO: 485) | (SEQ ID NO: 486) | (SEQ ID NO: 487) | (SEQ ID NO: 488) |
| >G141016_k105_90141_1 | >ERR2017581_k103_70168_14 | >G36356_k105_57170_9 | >ERR2017615_k103_36116_37 |
| (SEQ ID NO: 489) | (SEQ ID NO: 490) | (SEQ ID NO: 491) | (SEQ ID NO: 492) |
| >G140954_k105_17301_3 | >MSM79HBB_R_k105_49201_3 | >CSM5MCWG_R_k105_9232_23 | >ERR2017631_k103_741556 |
| (SEQ ID NO: 493) | (SEQ ID NO: 494) | (SEQ ID NO: 495) | (SEQ ID NO: 496) |
| >G140994_k105_55384_2 | >G48792_k105_47770_55 | >HSM7J4JH_R_k105_5288_2 | >G72714_k105_52650_12 |
| (SEQ ID NO: 497) | (SEQ ID NO: 498) | (SEQ ID NO: 499) | (SEQ ID NO: 500) |
| >G48842_k105_5799_2 | >MSM9VZNH_R_k105_50637_2 | >PSMA2668_R_k105_22069_5 | >ERR2017640_k103_57642_11 |
| (SEQ ID NO: 501) | (SEQ ID NO: 502) | (SEQ ID NO: 503) | (SEQ ID NO: 504) |
| >G48791_k105_197996_43 | >CSM79HI7_R_k105_30053_2 | >G140017_k105_53136_4 | >ERR2017616_k103_92453_2 |
| (SEQ ID NO: 505) | (SEQ ID NO: 506) | (SEQ ID NO: 507) | (SEQ ID NO: 508) |
| >G140785_k105_27068_4 | >G140922_k105_25190_14 | >G89182_k105_96582_12 | >G140170_k105_34453_1 |
| (SEQ ID NO: 509) | (SEQ ID NO: 510) | (SEQ ID NO: 511) | L (SEQ ID NO: 512) |
| >G48821_k105_15594_4 | >G36359_k105_30659_14 | >G48819_k105_3951_2 | >ERR2017618_k103_99515_8 |
| (SEQ ID NO: 513) | (SEQ ID NO: 514) | (SEQ ID NO: 515) | I (SEQ ID NO: 516) |
| >ERR2017611_k103_55710_1 | >G36392_k105_26849_1 | >MSM5LLEP_R_k105_14521_2 | >ERR2017656_k103_73644_2 |
| (SEQ ID NO: 517) | (SEQ ID NO: 518) | (SEQ ID NO: 519) | (SEQ ID NO: 520) |

TABLE 8-continued

Protein sequences identifiers from the combined assembly that share at least 20% AA identity to ECOP170.

| | | | |
|---|---|---|---|
| >G48791_k105_6352_2 (SEQ ID NO: 521) | >ERR2017623_k103_15392_9 (SEQ ID NO: 522) | >CSM5MCXN_R_k105_40367_5 (SEQ ID NO: 5239) | >G72703_k105_93504_221 (SEQ ID NO: 524) |
| >MSM9VZHB_R_k105_7308_3 (SEQ ID NO: 525) | >G48822_k105_3561_1 (SEQ ID NO: 526) | >G48814_k105_38059_3 (SEQ ID NO: 527) | >ERR2017499_k103_15424_9 (SEQ ID NO: 528) |
| >G48838_k105_78496_1 (SEQ ID NO: 529) | >G72682_k105_33380_1 (SEQ ID NO: 530) | >CSM7KOLY_R_k105_23631_22 (SEQ ID NO: 531) | >ERR2017570_k103_9731_2 (SEQ ID NO: 532) |
| >G140808_k105_19783_1 (SEQ ID NO: 533) | >G88922_k105_28537_7 (SEQ ID NO: 534) | >ERR2017636_k103_1676_2 (SEQ ID NO: 535) | >CSM7KOS7_R_k105_32171_23 (SEQ ID NO: 536) |
| >CSM5MCYS_R_k105_6727_3 (SEQ ID NO: 537) | >ERR2017637_k103_71747_3 (SEQ ID NO: 538) | >ERR2017667_k103_23517_2 (SEQ ID NO: 539) | >G140880_k105_13384_3 (SEQ ID NO: 540) |
| >G72683_k105_9408_11 (SEQ ID NO: 541) | >ERR2017541_k103_42614_1 (SEQ ID NO: 542) | >CSM5MCWQ_R_k105_13885_2 (SEQ ID NO: 543) | >PSM7J1BP_R_k105_4738_2 (SEQ ID NO: 544) |
| >G48798_k105_40920_33 (SEQ ID NO: 545) | >ERR2017696_k103_41202_3 (SEQ ID NO: 546) | >ERR2017614_k103_31226_117 (SEQ ID NO: 547) | >G140896_k105_63696_15 (SEQ ID NO: 548) |
| >G104998_k105_7853_4 (SEQ ID NO: 549) | >G48826_k105_19931_2 (SEQ ID NO: 550) | >G139981_k105_50127_24 (SEQ ID NO: 551) | >G140123_k105_94472_13 (SEQ ID NO: 552) |
| >G36355_k105_45725_3 (SEQ ID NO: 553) | >ERR2017679_k103_31271_57 (SEQ ID NO: 554) | >G140880_k105_25835_2 (SEQ ID NO: 555) | >G72703_k105_73123_2 (SEQ ID NO: 556) |
| >MSM5LLF6_R_k105_38794_2 (SEQ ID NO: 557) | >HSM5MD8J_PR_k105_28407_2 (SEQ ID NO: 558) | >G140133_k105_11020_2 (SEQ ID NO: 559) | >G140898_k105_71565_3 (SEQ ID NO: 560) |
| >G104926_k105_4769_3 (SEQ ID NO: 561) | >ERR2017447_k93_44449_16 (SEQ ID NO: 562) | >G141086_k105_32575_2 (SEQ ID NO: 563) | >ERR2017569_k103_32123_1 (SEQ ID NO: 564) |
| >G140202_k105_54624_7 (SEQ ID NO: 565) | >ERR2017692_k103_55436_2 (SEQ ID NO: 566) | >G104923_k105_10415_2 (SEQ ID NO: 567) | >ERR2017495_k79_53186_2 (SEQ ID NO: 568) |
| >G139953_k105_6325_8 (SEQ ID NO: 569) | >CSM79HNI_R_k105_32627_11 (SEQ ID NO: 570) | >ERR2017447_k93_35502_8 (SEQ ID NO: 571) | >HSM5MD7Q_R_k105_12755_5 (SEQ ID NO: 572) |
| >G88790_k105_50573_1 (SEQ ID NO: 573) | >G48831_k105_96700_28 (SEQ ID NO: 574) | >G140786_k105_12264_2 (SEQ ID NO: 575) | >G48784_k105_134757_2 (SEQ ID NO: 576) |
| >G48819_k105_8488_13 (SEQ ID NO: 577) | >ERR2017669_k103_1204_14 (SEQ ID NO: 578) | >ERR2017519_k103_10728_7 (SEQ ID NO: 579) | >ERR2017616_k103_40933_3 (SEQ ID NO: 580) |
| >G89005_k105_31711_1 (SEQ ID NO: 581) | >G140158_k105_24836_2 (SEQ ID NO: 582) | >G48795_k105_40107_2 (SEQ ID NO: 583) | >G140896_k105_60581_1 (SEQ ID NO: 584) |
| >MSM9VZOK_R_k105_36925_1 (SEQ ID NO: 585) | >G48836_k105_297_13 (SEQ ID NO: 586) | >ERR2017650_k103_32187_1 (SEQ ID NO: 587) | >MSM5LLE3_P_R_k105_19190_12 (SEQ ID NO: 588) |
| >HSM67VEO_R_k105_8042_1 (SEQ ID NO: 589) | >ERR2017613_k103_45054_1 (SEQ ID NO: 590) | >G140880_k105_29002_6 (SEQ ID NO: 591) | >ERR2017569_k103_106426_68 (SEQ ID NO: 592) |
| >G140022_k105_20980_2 (SEQ ID NO: 5939) | >G48806_k105_6571_16 (SEQ ID NO: 594) | >ERR2017523_k103_54949_7 (SEQ ID NO: 595) | >G140758_k105_498_2 (SEQ ID NO: 596) |
| >G72720_k105_63499_8 (SEQ ID NO: 597) | >ERR2017720_k103_27620_3 (SEQ ID NO: 598) | >G89027_k105_33505_17 (SEQ ID NO: 599) | >ERR2017560_k103_25520_13 (SEQ ID NO: 600) |
| >ERR2017729_k103_69352_9 (SEQ ID NO: 601) | >HSM67VFX_P_R_k105_27767_1 (SEQ ID NO: 602) | >MSM9VZMC_R_k105_1759_2 (SEQ ID NO: 603) | >G140078_k105_32068_1 (SEQ ID NO: 604) |
| >CSM67UAA_R_k105_7303_317 (SEQ ID NO: 605) | >G105060_k105_55730_7 (SEQ ID NO: 606) | >G140944_k105_16781_2 (SEQ ID NO: 607) | >G89058_k105_67579_2 (SEQ ID NO: 608) |
| >ERR2017649_k103_38406_4 (SEQ ID NO: 609) | >G140929_k105_26270_2 (SEQ ID NO: 610) | >G141012_k105_1567_3 (SEQ ID NO: 611) | >ERR2017603_k103_31149_3 (SEQ ID NO: 612) |
| >G140183_k105_49941_12 (SEQ ID NO: 613) | >ERR2017571_k103_23286_5 (SEQ ID NO: 614) | >MSM79HBR_R_k105_20818_96 (SEQ ID NO: 615) | >ERR2017653_k103_72195_2 (SEQ ID NO: 616) |
| >ERR2017635_k103_44512_154 (SEQ ID NO: 617) | >G72701_k105_48495_35 (SEQ ID NO: 618) | >G141819_k105_10609_4 (SEQ ID NO: 619) | >ERR2017645_k103_27071_3 (SEQ ID NO: 620) |
| >G139962_k105_44646_2 (SEQ ID NO: 621) | >G140922_k105_40896_2 (SEQ ID NO: 622) | >G140812_k105_74353_12 (SEQ ID NO: 623) | >ERR2017639_k103_20019_5 (SEQ ID NO: 624) |
| >MSM79H9K_R_k105_2566_3 (SEQ ID NO: 625) | >G48806_k105_25902_4 (SEQ ID NO: 626) | >G36392_k105_47848_68 (SEQ ID NO: 627) | >G48817_k105_42413_2 (SEQ ID NO: 628) |
| >G88707_k105_86775_1 (SEQ ID NO: 629) | >PSM7J14L_R_k105_3955_127 (SEQ ID NO: 630) | >G48806_k105_19999_2 (SEQ ID NO: 631) | >ERR2017430_k93_8771_2 (SEQ ID NO: 632) |
| >MSM9VZMM_R_k105_17369_15 (SEQ ID NO: 633) | >ERR2017569_k103_125456_9 (SEQ ID NO: 634) | >G140202_k105_73433_3 (SEQ ID NO: 635) | >G48796_k105_110428_17 (SEQ ID NO: 636) |
| >ERR2017673_k103_108417_7 (SEQ ID NO: 637) | >PSM7J14L_R_k105_704_4 (SEQ ID NO: 638) | >PSM7J1A2_R_k105_41830_4 (SEQ ID NO: 639) | >G72705_k105_13805_1 (SEQ ID NO: 640) |
| >ERR2017630_k103_46512_2 (SEQ ID NO: 641) | >ERR2017686_k103_70767_3 (SEQ ID NO: 642) | >G141001_k105_1032_16 (SEQ ID NO: 643) | >ERR2017631_k103_67330_2 (SEQ ID NO: 644) |
| >ERR2017465_k103_36271_2 (SEQ ID NO: 645) | >G72728_k105_18244_1 (SEQ ID NO: 646) | >ERR2017553_k103_17444_16 (SEQ ID NO: 647) | >G141077_k105_7789_2 (SEQ ID NO: 648) |
| >G141014_k105_89139_1 (SEQ ID NO: 649) | >ERR2017460_k93_53799_72 (SEQ ID NO: 650) | >G105108_k105_69257_2 (SEQ ID NO: 651) | >ERR2017675_k103_105871_2 (SEQ ID NO: 652) |
| >G141007_k105_20199_3 (SEQ ID NO: 653) | >ERR2017685_k103_22047_2 (SEQ ID NO: 654) | >G140819_k105_73793_3 (SEQ ID NO: 655) | >G104817_k105_7956_3 (SEQ ID NO: 656) |
| >G140899_k105_13945_6 (SEQ ID NO: 657) | >G105082_k105_68803_2 (SEQ ID NO: 658) | >ERR2017533_k103_21325_9 (SEQ ID NO: 659) | >ERR2017645_k103_8615_2 (SEQ ID NO: 660) |

TABLE 8-continued

Protein sequences identifiers from the combined assembly that share at least 20% AA identity to ECOP170.

| | | | |
|---|---|---|---|
| >G105095_k105_22590_1 (SEQ ID NO: 661) | >ERR2017411_k93_31527_52 (SEQ ID NO: 662) | >G48820_k105_10194_59 (SEQ ID NO: 663) | >ERR2017545_k103_30362_5 (SEQ ID NO: 664) |
| >ERR2017618_k103_58465_2 (SEQ ID NO: 665) | >G48784_k105_9215_6 (SEQ ID NO: 666) | >MSMA26DG_R_k105_19716_2 (SEQ ID NO: 667) | >ERR2017705_k103_32472_164 (SEQ ID NO: 668) |
| >G48815_k105_38100_1 (SEQ ID NO: 669) | >ERR2017686_k103_101137_91 (SEQ ID NO: 670) | >HSMA33IA_R_k105_28475_2 (SEQ ID NO: 671) | >G72704_k105_35507_2 (SEQ ID NO: 672) |
| >G88988_k105_31485_1 (SEQ ID NO: 673) | >ESM5MEB7_R_k105_42582_2 (SEQ ID NO: 674) | >ERR2017570_k103_24913_14 (SEQ ID NO: 675) | >ERR2017650_k103_100733_2 (SEQ ID NO: 676) |
| >G36365_k105_42273_10 (SEQ ID NO: 677) | >G140163_k105_13531_17 (SEQ ID NO: 678) | >ERR2017533_k103_82027_2 (SEQ ID NO: 679) | >G88801_k105_91964_2 (SEQ ID NO: 680) |
| >G140946_k105_95626_8 (SEQ ID NO: 681) | >G48780_k105_27701_9 (SEQ ID NO: 682) | >G105082_k105_52529_2 (SEQ ID NO: 683) | >G140969_k105_53042_4 (SEQ ID NO: 684) |
| >ERR2017551_k103_22818_20 (SEQ ID NO: 685) | >G140075_k105_10623_8 (SEQ ID NO: 686) | >HSM7J4MS_R_k105_13677_1 (SEQ ID NO: 687) | >G140815_k105_17357_1 (SEQ ID NO: 688) |
| >MSMA26AX_R_k105_23254_2 (SEQ ID NO: 689) | >CSM79HNK_R_k105_14655_2 (SEQ ID NO: 690) | >ERR2017522_k103_4715_2 (SEQ ID NO: 691) | >G88888_k105_15847_5 (SEQ ID NO: 692) |
| >G48798_k105_72677_20 (SEQ ID NO: 693) | >ERR2017470_k103_59428_1 (SEQ ID NO: 694) | >G104883_k105_8912_2 (SEQ ID NO: 695) | >G48777_k105_58599_4 (SEQ ID NO: 696) |
| >ERR2017529_k103_2513_47 (SEQ ID NO: 697) | >G48820_k105_10194_30 (SEQ ID NO: 698) | >ERR2017553_k103_35130_4 (SEQ ID NO: 699) | >ERR2017611_k103_21696_6 (SEQ ID NO: 700) |
| >CSM67UAA_R_k105_9341_98 (SEQ ID NO: 701) | >MSM5LLH2_P_R_k105_885_16 (SEQ ID NO: 702) | >ERR2017704_k103_50742_18 (SEQ ID NO: 703) | >G72676_k105_18744_53 (SEQ ID NO: 704) |
| >G140974_k105_29066_3 (SEQ ID NO: 705) | >G140807_k105_54983_2 (SEQ ID NO: 706) | >G140795_k105_25218_3 (SEQ ID NO: 707) | >G48790_k105_232273_10 (SEQ ID NO: 708) |
| >G140170_k105_28494_3 (SEQ ID NO: 709) | >G88922_k105_31346_4 (SEQ ID NO: 710) | >G104829_k105_55725_2 (SEQ ID NO: 711) | >G140763_k105_42939_2 (SEQ ID NO: 712) |
| >G48839_k105_52798_10 (SEQ ID NO: 713) | >ERR2017434_k93_92272_8 (SEQ ID NO: 714) | >ERR2017707_k103_42217_5 (SEQ ID NO: 715) | >G140842_k105_75049_1 (SEQ ID NO: 716) |
| >G104951_k105_10284_2 (SEQ ID NO: 717) | >ERR2017692_k103_109873_2 (SEQ ID NO: 718) | >G88933_k105_34966_2 (SEQ ID NO: 719) | >MSM79HF5_R_k105_44724_1 (SEQ ID NO: 720) |
| >G48842_k105_53827_1 (SEQ ID NO: 721) | >G48842_k105_44309_2 (SEQ ID NO: 722) | >G140176_k105_10093_4 (SEQ ID NO: 723) | >ERR2017650_k103_99395_4 (SEQ ID NO: 724) |
| >G105055_k105_7528_7 (SEQ ID NO: 725) | >G48786_k105_13537_5 (SEQ ID NO: 726) | >G89162_k105_47625_2 (SEQ ID NO: 727) | >ERR2017652_k103_5201_2 (SEQ ID NO: 728) |
| >MSMAPC5Z_R_k105_34057_2 (SEQ ID NO: 729) | >G104932_k105_34100_1 (SEQ ID NO: 730) | >G105028_k105_17685_16 (SEQ ID NO: 731) | >ERR2017638_k103_24129_2 (SEQ ID NO: 732) |
| >CSM79HJS_R_k105_24378_2 (SEQ ID NO: 733) | >G104829_k105_19574_4 (SEQ ID NO: 734) | >HSM5MD57_P_R_k105_32686_3 (SEQ ID NO: 735) | >ERR2017705_k103_31391_15 (SEQ ID NO: 736) |
| >G105000_k105_71576_26 (SEQ ID NO: 737) | >G48836_k105_6741_54 (SEQ ID NO: 738) | >G72724_k105_56209_57 (SEQ ID NO: 739) | >ERR2017682_k103_61144_2 (SEQ ID NO: 740) |
| >G36355_k105_53467_3 (SEQ ID NO: 741) | >ERR2017639_k103_56786_2 (SEQ ID NO: 742) | >G141016_k105_75496_1 (SEQ ID NO: 743) | >G104940_k105_62353_9 (SEQ ID NO: 744) |
| >ERR2017735_k103_48650_67 (SEQ ID NO: 745) | >ERR2017565_k103_75451_77 (SEQ ID NO: 746) | >G72673_k105_48013_51 (SEQ ID NO: 747) | >ERR2017645_k103_50783_2 (SEQ ID NO: 748) |
| >G48819_k105_13403_4 (SEQ ID NO: 749) | >HSM7J4NU_R_k105_60563_136 (SEQ ID NO: 750) | >G89136_k105_16579_1 (SEQ ID NO: 751) | >HSM7J4JH_R_k105_14118_58 (SEQ ID NO: 752) |
| >ERR2017704_k103_76394_3 (SEQ ID NO: 753) | >PSM7J17B_R_k105_3018_2 (SEQ ID NO: 754) | >G88922_k105_60299_2 (SEQ ID NO: 755) | >G48796_k105_118317_45 (SEQ ID NO: 756) |
| >G48838_k105_70727_1 (SEQ ID NO: 757) | >G48842_k105_13133_55 (SEQ ID NO: 758) | >CSM79HHM_R_k105_472_19 (SEQ ID NO: 759) | >ERR2017653_k103_22656_6 (SEQ ID NO: 760) |
| >G105091_k105_21628_1 (SEQ ID NO: 761) | >G140062_k105_5474_4 (SEQ ID NO: 762) | >G141126_k105_108681_4 (SEQ ID NO: 763) | >G72710_k105_20611_6 (SEQ ID NO: 764) |
| >G48790_k105_239255_7 (SEQ ID NO: 765) | >ERR2017672_k103_70607_17 (SEQ ID NO: 766) | >G48802_k105_52165_1 (SEQ ID NO: 767) | >G88829_k105_87104_2 (SEQ ID NO: 768) |
| >G104878_k105_15631_6 (SEQ ID NO: 769) | >ERR2017542_k103_24755_5 (SEQ ID NO: 770) | >G105028_k105_26718_13 (SEQ ID NO: 771) | >G48806_k105_9468_219 (SEQ ID NO: 772) |
| >ERR2017455_k93_45055_30 (SEQ ID NO: 773) | >HSMA33KQ_R_k105_5162_3 (SEQ ID NO: 774) | >G140127_k105_18896_4 (SEQ ID NO: 775) | >G48814_k105_41735_16 (SEQ ID NO: 776) |
| >ERR2017487_k79_31161_2 (SEQ ID NO: 777) | >G72708_k105_31001_38 (SEQ ID NO: 778) | >G89108_k105_6460_20 (SEQ ID NO: 779) | >CSM79HOZ_R_k105_13353_3 (SEQ ID NO: 780) |
| >G105109_k105_59939_2 (SEQ ID NO: 781) | >G36349_k105_11369_2 (SEQ ID NO: 782) | >ERR2017460_k93_22387_19 (SEQ ID NO: 783) | >ERR2017615_k103_1926_2 (SEQ ID NO: 784) |
| >G139975_k105_13036_15 (SEQ ID NO: 785) | >ERR2017717_k103_52830_2 (SEQ ID NO: 786) | >G88838_k105_67115_10 (SEQ ID NO: 787) | >ERR2017438_k93_36824_5 (SEQ ID NO: 788) |
| >G48814_k105_11470_43 (SEQ ID NO: 789) | >G140845_k105_91673_1 (SEQ ID NO: 790) | >MSM5LLHG_P_R_k105_2772_35 (SEQ ID NO: 791) | >G104997_k105_6428_1 (SEQ ID NO: 792) |
| >G140114_k105_36925_5 (SEQ ID NO: 793) | >G140906_k105_41161_5 (SEQ ID NO: 794) | >G140166_k105_29852_2 (SEQ ID NO: 795) | >G48842_k105_48485_10 (SEQ ID NO: 796) |
| >G140757_k105_15337_2 (SEQ ID NO: 797) | >G104872_k105_46453_1 (SEQ ID NO: 798) | >G140794_k105_47545_1 (SEQ ID NO: 799) | >ERR2017630_k103_14364_7 (SEQ ID NO: 800) |
| >G140035_k105_98244_2 (SEQ ID NO: 801) | >G104996_k105_64940_13 (SEQ ID NO: 802) | >G36350_k105_22840_9 (SEQ ID NO: 803) | >ERR2017590_k103_24140_5 (SEQ ID NO: 804) |

TABLE 8-continued

Protein sequences identifiers from the combined assembly that share at least 20% AA identity to ECOP170.

| | | | |
|---|---|---|---|
| >G104953_k105_31882_18 (SEQ ID NO: 805) | >G140198_k105_262_3 (SEQ ID NO: 806) | >ERR2017683_k103_72749_36 (SEQ ID NO: 807) | >ERR2017708_k103_76473_2 (SEQ ID NO: 808) |
| >G141006_k105_82582_13 (SEQ ID NO: 809) | >ERR2017576_k103_66017_3 (SEQ ID NO: 810) | >ERR2017626_k103_33873_3 (SEQ ID NO: 811) | >ERR2017659_k103_13861_17 (SEQ ID NO: 812) |
| >MSMA26BX_R_k105_8138_1 (SEQ ID NO: 813) | >ERR2017631_k103_13007_10 (SEQ ID NO: 814) | >G72690_k105_11219_11 (SEQ ID NO: 815) | >ERR2017665_k103_48093_11 (SEQ ID NO: 816) |
| >ERR2017586_k103_8649_6 (SEQ ID NO: 817) | >G48792_k105_106365_2 (SEQ ID NO: 818) | >MSM79HBR_R_k105_13912_60 (SEQ ID NO: 819) | >G48807_k105_120238_6 (SEQ ID NO: 820) |
| >G89067_k105_38969_11 (SEQ ID NO: 821) | >G140965_k105_53271_3 (SEQ ID NO: 822) | >G48807_k105_71348_2 (SEQ ID NO: 823) | >ERR2017644_k103_53390_2 (SEQ ID NO: 824) |
| >G48792_k105_39954_4 (SEQ ID NO: 825) | >ERR2017560_k103_31723_132 (SEQ ID NO: 826) | >G140066_k105_33923_60 (SEQ ID NO: 827) | >ERR2017674_k103_2001_1 (SEQ ID NO: 828) |
| >G48784_k105_68315_28 (SEQ ID NO: 829) | >G36370_k105_2703_6 (SEQ ID NO: 830) | >G140760_k105_25722_5 (SEQ ID NO: 831) | >G89121_k105_44588_3 (SEQ ID NO: 832) |
| >CSM79HM7_R_k105_44927_1 (SEQ ID NO: 833) | >G48817_k105_153705_4 (SEQ ID NO: 834) | >ERR2017568_k103_15909_14 (SEQ ID NO: 835) | >G89274_k105_28687_1 (SEQ ID NO: 836) |
| >G89065_k105_45479_45 (SEQ ID NO: 837) | >G89114_k105_73923_2 (SEQ ID NO: 838) | >G140109_k105_79476_1 (SEQ ID NO: 839) | >G140202_k105_59108_3 (SEQ ID NO: 840) |
| >G104891_k105_9620_15 (SEQ ID NO: 841) | >MSMA26AZ_TR_R_k105_16815_2 (SEQ ID NO: 842) | >G72718_k105_111961_2 (SEQ ID NO: 843) | >ERR2017588_k103_108861_1 (SEQ ID NO: 844) |
| >ERR2017611_k103_101768_2 (SEQ ID NO: 845) | >MSM6J2HT_R_k105_19441_2 (SEQ ID NO: 846) | >E5M718V8_R_k105_13178_2 (SEQ ID NO: 847) | >G88798_k105_24965_1 (SEQ ID NO: 848) |
| >ERR2017489_k79_67320_1 (SEQ ID NO: 849) | >HSM67VHJ_R_k105_27562_2 (SEQ ID NO: 850) | >G140130_k105_69611_44 (SEQ ID NO: 851) | >G48838_k105_75333_3 (SEQ ID NO: 852) |
| >ERR2017651_k103_27728_1 (SEQ ID NO: 853) | >G140004_k1054550_2 (SEQ ID NO: 854) | >G48819_k105_5295_33 (SEQ ID NO: 855) | >PSMA264W_R_k105_14772_1 (SEQ ID NO: 856) |
| >G140834_k105_17762_1 (SEQ ID NO: 857) | >ERR2017464_k103_2636_3 (SEQ ID NO: 858) | >G139962_k105_9708_29 (SEQ ID NO: 859) | >G105016_k105_27408_1 (SEQ ID NO: 860) |
| >G89268_k105_5906_8 (SEQ ID NO: 861) | >G88887_k105_2260_4 (SEQ ID NO: 862) | >G72697_k105_51499_3 (SEQ ID NO: 863) | >G48807_k105_85359_4 (SEQ ID NO: 864) |
| >ERR2017734_k103_25782_5 (SEQ ID NO: 865) | >ESM5ME9D_P_R_k105_8239_28 (SEQ ID NO: 866) | >G88847_k105_45228_2 (SEQ ID NO: 867) | >G140839_k105_60449_2 (SEQ ID NO: 868) |
| >ERR2017674_k103_6521_19 (SEQ ID NO: 869) | >MSM79H98_R_k105_18235_68 (SEQ ID NO: 870) | >MSM5LLE3_P_R_k105_35173_16 (SEQ ID NO: 871) | >G140162_k105_65352_3 (SEQ ID NO: 872) |
| >MSM5ZOJY_P_R_k105_4664_23 (SEQ ID NO: 873) | >G36385_k105_717_61 (SEQ ID NO: 874) | >ERR2017565_k103_10031_68 (SEQ ID NO: 875) | >CSM67UAA_R_k105_3231_22 (SEQ ID NO: 876) |
| >G105099_k105_23001_18 (SEQ ID NO: 877) | >G88892_k105_8741_4 (SEQ ID NO: 878) | >G140856_k105_25451_6 (SEQ ID NO: 879) | >G140164_k105_54779_1 (SEQ ID NO: 880) |
| >MSM79HFY_R_k105_21547_2 (SEQ ID NO: 881) | >G48820_k105_13546_15 (SEQ ID NO: 882) | >G88838_k105_56902_7 (SEQ ID NO: 883) | >G88935_k105_37556_2 (SEQ ID NO: 884) |
| >PSM7J15Q_R_k105_1823_4 (SEQ ID NO: 885) | >G89089_k105_25643_13 (SEQ ID NO: 886) | >G88755_k105_74875_2 (SEQ ID NO: 887) | >G89098_k105_42465_2 (SEQ ID NO: 888) |
| >MSM5LLF4_R_k105_25657_4 (SEQ ID NO: 889) | >G48812_k105_41366_2 (SEQ ID NO: 890) | >G88903_k105_20096_2 (SEQ ID NO: 891) | >G48804_k105_2940_74 (SEQ ID NO: 892) |
| >G104860_k105_1317_1 (SEQ ID NO: 893) | >G48817_k105_56869_4 (SEQ ID NO: 894) | >ERR2017472_k79_29458_1 (SEQ ID NO: 895) | >G105000_k105_29605_5 (SEQ ID NO: 896) |
| >G48815_k105_10150_2 (SEQ ID NO: 897) | >ERR2017561_k103_51819_2 (SEQ ID NO: 898) | >G89146_k105_68058_13 (SEQ ID NO: 899) | >G48817_k105_85681_52 (SEQ ID NO: 900) |
| >G140839_k105_7117_2 (SEQ ID NO: 901) | >G88870_k105_83264_2 (SEQ ID NO: 902) | >G104923_k105_16556_4 (SEQ ID NO: 903) | >ERR2017696_k103_37858_5 (SEQ ID NO: 904) |
| >G104977_k105_77974_2 (SEQ ID NO: 905) | >ERR2017660_k103_41592_2 (SEQ ID NO: 906) | >G48791_k105_15153_2 (SEQ ID NO: 907) | >G48821_k105_7671_13 (SEQ ID NO: 908) |
| >ERR2017541_k103_60115_6 (SEQ ID NO: 909) | >ERR2017629_k103_66774_5 (SEQ ID NO: 910) | >ERR2017581_k103_89684_63 (SEQ ID NO: 911) | >ERR2017446_k93_11340_6 (SEQ ID NO: 912) |
| >MSM79H54_R_k105_50312_159 (SEQ ID NO: 913) | >G48804_k105_2722_2 (SEQ ID NO: 914) | >MSM79HBR_R_k105_14580_1 (SEQ ID NO: 915) | >ERR2017681_k103_69143_1 (SEQ ID NO: 916) |
| >ERR2017466_k103_20068_8 (SEQ ID NO: 917) | >G48791_k105_118790_2 (SEQ ID NO: 918) | >G104888_k105_56380_1 (SEQ ID NO: 919) | >CSM5FZ3V_P_R_k105_16476_5 (SEQ ID NO: 920) |
| >G104973_k105_47504_1 (SEQ ID NO: 921) | >ERR2017688_k103_30300_14 (SEQ ID NO: 922) | >G105094_k105_35102_3 (SEQ ID NO: 923) | >G140010_k105_57627_4 (SEQ ID NO: 924) |
| >ERR2017622_k103_28892_5 (SEQ ID NO: 925) | >ERR2017686_k103_43877_2 (SEQ ID NO: 926) | >G141125_k105_66799_2 (SEQ ID NO: 927) | >ERR2017605_k103_89465_4 (SEQ ID NO: 928) |
| >G140926_k105_10107_1 (SEQ ID NO: 929) | >G48790_k105_15375_2 (SEQ ID NO: 930) | >G140004_k105_20922_4 (SEQ ID NO: 931) | >G104984_k105_97839_1 (SEQ ID NO: 932) |
| >G141111_k105_1068_1 (SEQ ID NO: 933) | >ERR2017569_k103_24093_16 (SEQ ID NO: 934) | >G139996_k105_1146_3 (SEQ ID NO: 935) | >ERR2017546_k103_42352_1 (SEQ ID NO: 936) |
| >G140964_k105_42289_4 (SEQ ID NO: 937) | >CSM7KORK_R_k105_22529_2 (SEQ ID NO: 938) | >ERR2017586_k103_14953_3 (SEQ ID NO: 939) | >G104890_k105_26539_4 (SEQ ID NO: 940) |
| >ERR2017736_k103_35998_2 (SEQ ID NO: 941) | >G140079_k105_4434_2 (SEQ ID NO: 942) | >G141131_k105_100422_5 (SEQ ID NO: 943) | >ERR2017562_k103_55879_3 (SEQ ID NO: 944) |
| >ERR2017611_k103_90975_57 (SEQ ID NO: 945) | >HSM67VDP_R_k105_1954_2 (SEQ ID NO: 946) | >G140137_k105_61767_2 (SEQ ID NO: 947) | >ERR2017449_k93_58342_6 (SEQ ID NO: 948) |

TABLE 8-continued

Protein sequences identifiers from the combined assembly that share at least 20% AA identity to ECOP170.

| | | | |
|---|---|---|---|
| >G48790_k105_174727_16 (SEQ ID NO: 949) | >G141012_k105_35467_1 (SEQ ID NO: 950) | >MSM9VZIQ_R_k105_46797_3 (SEQ ID NO: 951) | >ERR2017559_k103_39112_104 (SEQ ID NO: 952) |
| >ERR2017555_k103_48286_16 (SEQ ID NO: 953) | >ERR2017536_k103_10069_2 (SEQ ID NO: 9540) | >ERR2017459_k93_24389_1 (SEQ ID NO: 955) | >G72697_k105_57353_25 (SEQ ID NO: 956) |
| >G140014_k105_73358_5 (SEQ ID NO: 957) | >ERR2017605_k103_112848_7 (SEQ ID NO: 958) | >G141033_k105_50684_2 (SEQ ID NO: 959) | >ERR2017503_k79_95428_2 (SEQ ID NO: 960) |
| >G48820_k105_10194_88 (SEQ ID NO: 961) | >MSM79HAJ_R_k105_43872_3 (SEQ ID NO: 962) | >G104902_k105_32791_3 (SEQ ID NO: 963) | >ERR2017556_k103_13482_18 (SEQ ID NO: 964) |
| >G36358_k105_12421_117 (SEQ ID NO: 965) | >MSM9VZLN_R_k105_76387_12 (SEQ ID NO: 966) | >G48787_k105_50245_77 (SEQ ID NO: 967) | >G140798_k105_91769_2 (SEQ ID NO: 968) |
| >G140963_k105_17761_2 (SEQ ID NO: 969) | >G72679_k105_829224 (SEQ ID NO: 970) | >G72736_k105_15451_30 (SEQ ID NO: 971) | >G140103_k105_62665_68 (SEQ ID NO: 972) |
| >MSM5LLE3_P_R_k105_35315_1 (SEQ ID NO: 973) | >ERR2017615_k103_3682_23 (SEQ ID NO: 974) | >G140022_k105_33871_24 (SEQ ID NO: 975) | >ERR2017574_k103_62596_22 (SEQ ID NO: 976) |
| >G36392_k105_10697_2 (SEQ ID NO: 977) | >G72705_k105_28418_3 (SEQ ID NO: 978) | >G140189_k105_25030_2 (SEQ ID NO: 979) | >G104969_k105_61463_1 (SEQ ID NO: 980) |
| >G104824_k105_28491_2 (SEQ ID NO: 981) | >ERR2017627_k103_4486_8 (SEQ ID NO: 982) | >PSM7J12V_R_k105_11226_13 (SEQ ID NO: 983) | >ERR2017671_k103_28810_2 (SEQ ID NO: 984) |
| >ERR2017692_k103_50246_1 (SEQ ID NO: 985) | >G48838_k105_62400_3 (SEQ ID NO: 986) | >G89024_k105_70708_2 (SEQ ID NO: 987) | >ERR2017647_k103_66279_2 (SEQ ID NO: 988) |
| >G36362_k105_86628_2 (SEQ ID NO: 989) | >G72711_k105_5691_12 (SEQ ID NO: 990) | >CSM79HGZ_R_k105_17914_6 (SEQ ID NO: 991) | >G88922_k105_5121_33 (SEQ ID NO: 992) |
| >ERR2017664_k103_46392_10 (SEQ ID NO: 993) | >G140849_k105_11260_1 (SEQ ID NO: 994) | >G72706_k105_48929_6 (SEQ ID NO: 995) | >G89256_k105_54395_10 (SEQ ID NO: 996) |
| >G48792_k105_104872_5 (SEQ ID NO: 997) | >G48804_k105_7820_2 (SEQ ID NO: 998) | >ERR2017543_k103_42400_53 (SEQ ID NO: 999) | >G141022_k105_9452_2 (SEQ ID NO: 1000) |
| >G139981_k105_7602_2 (SEQ ID NO: 1001) | >G140978_k105_63578_1 (SEQ ID NO: 1002) | >G141072_k105_3486_5 (SEQ ID NO: 1003) | >ERR2017551_k103_58834_2 (SEQ ID NO: 1004) |
| >G36386_k105_33690_2 MCVYLASQRSSYVHGVTINVAGGKTRG (SEQ ID NO: 1005) | >G141071_k105_26898_3 (SEQ ID NO: 1006) | >G48786_k105_293_9 (SEQ ID NO: 1007) | >ERR2017547_k103_31831_32 (SEQ ID NO: 1008) |
| >MSM5FZA2_P_R_k105_41796_2 (SEQ ID NO: 1009) | >G141119_k1055509_2 (SEQ ID NO: 1010) | >G140872_k105_23093_4 (SEQ ID NO: 1011) | >ERR2017586_k103_34313_1 (SEQ ID NO: 1012) |
| >G88922_k105_31372_2 (SEQ ID NO: 1013) | >G48791_k105_121636_5 (SEQ ID NO: 1014) | >G88990_k105_18624_3 (SEQ ID NO: 1015) | >MSM5LLF2_P_R_k105_7521_1 (SEQ ID NO: 1016) |
| >ERR2017713_k103_3738_16 (SEQ ID NO: 1017) | >G48812_k105_43678_116 (SEQ ID NO: 1018) | >G140884_k105_50467_11 (SEQ ID NO: 1019) | >G104823_k105_6038_3 (SEQ ID NO: 1020) |
| >G72679_k105_14370_2 (SEQ ID NO: 1021) | >MSM6J2MB_R_k105_1120_15 (SEQ ID NO: 1022) | >MSM79H94_P_R_k105_23487_3 (SEQ ID NO: 1023) | >ERR2017589_k103_23068_7 (SEQ ID NO: 1024) |
| >CSM67UFZ_R_k105_15295_1 (SEQ ID NO: 1025) | >G140940_k105_2539_6 (SEQ ID NO: 1026) | >ERR2017512_k79_51552_17 (SEQ ID NO: 1027) | >ERR2017579_k103_7547_7 (SEQ ID NO: 1028) |
| >G105040_k105_42142_63 (SEQ ID NO: 1029) | >G104942_k105_86095_1 (SEQ ID NO: 1030) | >ERR2017545_k103_41987_4 (SEQ ID NO: 1031) | >ERR2017534_k103_93173_1 (SEQ ID NO: 1032) |
| >G140077_k105_8391_2 (SEQ ID NO: 1033) | >G104827_k105_55720_3 (SEQ ID NO: 1034) | >ERR2017676_k103_73473_3 (SEQ ID NO: 1035) | >G36369_k105_23328_1 (SEQ ID NO: 1036) |
| >G72679_k105_23874_2 (SEQ ID NO: 1037) | >G140928_k105_58936_9 (SEQ ID NO: 1038) | >G140138_k105_50244_2 (SEQ ID NO: 1039) | >ERR2017667_k103_16253_3 (SEQ ID NO: 1040) |
| >ERR2017564_k103_99141_2 (SEQ ID NO: 1041) | >G104973_k105_42961_8 (SEQ ID NO: 1042) | >G105014_k105_14111_16 (SEQ ID NO: 1043) | >G141104_k105_29546_8 (SEQ ID NO: 1044) |
| >G48798_k105_49523_6 (SEQ ID NO: 1045) | >ERR2017478_k79_27058_2 (SEQ ID NO: 1046) | >G48831_k105_99278_1 (SEQ ID NO: 1047) | >ERR2017659_k103_167409_2 (SEQ ID NO: 1048) |
| >ERR2017735_k103_63910_58 (SEQ ID NO: 1049) | >G140174_k105_28044_2 (SEQ ID NO: 1050) | >G48832_k105_22286_20 (SEQ ID NO: 1051) | >G88908_k105_27555_3 (SEQ ID NO: 1052) |
| >G36363_k105_53538_29 (SEQ ID NO: 1053) | >ERR2017733_k103_40423_1 (SEQ ID NO: 1054) | >ERR2017614_k103_87945_15 (SEQ ID NO: 1055) | >ERR2017592_k103_16547_2 (SEQ ID NO: 1056) |
| >MSMA26EJ_R_k105_4692_1 (SEQ ID NO: 1057) | >ERR2017638_k103_20377_1 (SEQ ID NO: 1058) | >ERR2017543_k103_47767_4 (SEQ ID NO: 1059) | >G140853_k105_81403_12 (SEQ ID NO: 1060) |
| >HSM7J4IQ_R_k105_33839_1 (SEQ ID NO: 1061) | >G48815_k105_21006_2 (SEQ ID NO: 1062) | >G48790_k105_1358_34 (SEQ ID NO: 1063) | >MSM5LLIC_P_R_k105_75349_10 (SEQ ID NO: 1064) |
| >G48791_k105_224813_2 (SEQ ID NO: 1065) | >ERR2017537_k103_30143_5 (SEQ ID NO: 1066) | >G140117_k105_32740_229 (SEQ ID NO: 1067) | >G72678_k105_7293_14 (SEQ ID NO: 1068) |
| >G48812_k105_28378_2 (SEQ ID NO: 1069) | >ERR2017555_k103_75266_3 (SEQ ID NO: 1070) | >G48836_k105_1332_16 (SEQ ID NO: 1071) | >G140946_k105_11013_8 (SEQ ID NO: 1072) |
| >MSM79H5E_R_k105_58710_2 (SEQ ID NO: 1073) | >G141818_k105_36847_3 (SEQ ID NO: 1074) | >G139962_k105_48290_10 (SEQ ID NO: 1075) | >G104978_k105_15301_14 (SEQ ID NO: 1076) |
| >HSMA33KQ_R_k105_11652_2 (SEQ ID NO: 1077) | >G48836_k105_7323_22 (SEQ ID NO: 1078) | >G48790_k105_233201_3 (SEQ ID NO: 1079) | >G48807_k105_67367_2 (SEQ ID NO: 1080) |
| >ERR2017467_k103_84641_2 (SEQ ID NO: 1081) | >G48819_k105_14733_12 (SEQ ID NO: 1082) | >G104950_k105_3862_20 (SEQ ID NO: 1083) | >G140956_k105_75731_4 (SEQ ID NO: 1084) |
| >G140761_k105_44585_1 (SEQ ID NO: 1085) | >ERR2017715_k103_86158_4 (SEQ ID NO: 1086) | >G104994_k105_63638_23 (SEQ ID NO: 1087) | >CSMA9J65_R_k105_5457_4 (SEQ ID NO: 1088) |

TABLE 8-continued

Protein sequences identifiers from the combined assembly that share at least 20% AA identity to ECOP170.

>ERR2017460_k93_13963_1
(SEQ ID NO: 1089)
>G141000_k105_72969_1
(SEQ ID NO: 1093)
>G105001_k105_20123_2
(SEQ ID NO: 1097)
>G48814_k105_22040_2
(SEQ ID NO: 1101)
>G140002_k105_58409_2
(SEQ ID NO: 1105)
>G140130_k105_69611_14
(SEQ ID NO: 1109)
>G140031_k105_81237_3
(SEQ ID NO: 1113)
>G141060_k105_8090_42
(SEQ ID NO: 1117)
>ERR2017736_k103_95772_1
(SEQ ID NO: 1121)
>ERR2017708_k103_82617_31
(SEQ ID NO: 1125)
>G140026_k105_32005_1
(SEQ ID NO: 1129)
>ERR2017590_k103_10699_4
(SEQ ID NO: 1133)
>G105021_k105_94587_3
(SEQ ID NO: 1137)
>ERR2017705_k103_70467_3
(SEQ ID NO: 1141)
>G140840_k105_36078_3
(SEQ ID NO: 1145)
>ERR2017731_k103_25150_2
(SEQ ID NO: 1149)
>MSMA2688_R_k105_44408_1
(SEQ ID NO: 1153)
>G140833_k105_44672_2
(SEQ ID NO: 1157)
>ERR2017717_k103_24391_2
(SEQ ID NO: 1161)
>ERR2017526_k103_44983_3
(SEQ ID NO: 1165)
>ERR2017564_k103_25576_75
(SEQ ID NO: 1169)
>G140844_k105_28329_2
(SEQ ID NO: 1173)
>HSM7J4MY_R_k105_26504_2
(SEQ ID NO: 1177)
>G104865_k105_31582_3
(SEQ ID NO: 1181)
>PSMA265T_R_k105_40770_3
(SEQ ID NO: 1185)
>G88693_k105_33027_5
(SEQ ID NO: 1189)
>ERR2017666_k103_7267_44
(SEQ ID NO: 1193)
>G140062_k105_19280_1
(SEQ ID NO: 1197)
>PSM7J19T_R_k105_32534_2
(SEQ ID NO: 1201)
>ERR2017731_k103_29660_2
(SEQ ID NO: 1205)
>ERR2017599_k103_65241_1
(SEQ ID NO: 1209)
>ERR2017663_k103_15658_4
(SEQ ID NO: 1213)
>ERR2017662_k103_17459_1
(SEQ ID NO: 1217)
>ERR2017605_k103_16380_2
(SEQ ID NO: 1221)
>CSM67UB3_R_k105_36722_1
(SEQ ID NO: 1225)
>G140911_k105_2500_6
(SEQ ID NO: 1229)
>G72712_k105_9819_2
(SEQ ID NO: 1233)
>CSM79HPA_TR_R_k105_18257_2
(SEQ ID NO: 1090)
>ERR2017675_k103_89501_3
(SEQ ID NO: 1094)
>G72737_k105_22406_2
(SEQ ID NO: 1098)
>ERR2017454_k93_45104_2
(SEQ ID NO: 1102)
>G104893_k105_24944_2
(SEQ ID NO: 1106)
>G72696_k105_6532_37
(SEQ ID NO: 1110)
>G48832_k105_61986_2
(SEQ ID NO: 1114)
>ERR2017700_k103_67776_4
(SEQ ID NO: 1118)
>G88828_k105_42831_2
(SEQ ID NO: 1122)
>G105000_k105_18211_2
(SEQ ID NO: 1126)
>G139953_k105_17905_48
(SEQ ID NO: 1130)
>G140936_k105_10836_2
(SEQ ID NO: 1134)
>G72676_k105_8404_3
(SEQ ID NO: 1138)
>G141092_k105_10981_4
(SEQ ID NO: 1142)
>ERR2017579_k103_111919_81
(SEQ ID NO: 1146)
>PSM7J15A_R_k105_38110_2
(SEQ ID NO: 1150)
>ERR2017598_k103_14921_3
(SEQ ID NO: 1154)
>G48812_k105_55617_2
(SEQ ID NO: 1158)
>HSM7J4NS_R_k105_64170_5
(SEQ ID NO: 1162)
>G104933_k105_101346_1
(SEQ ID NO: 1166)
>ERR2017596_k103_13147_6
(SEQ ID NO: 1170)
>ERR2017570_k103_17133_10
(SEQ ID NO: 1174)
>MSM5FZ9N_P_R_k105_31088_3
(SEQ ID NO: 1178)
>G140880_k105_14667_6
(SEQ ID NO: 1182)
>ERR2017639_k103_46545_4
(SEQ ID NO: 1186)
>ERR2017637_k103_21547_28
(SEQ ID NO: 1190)
>G141010_k105_32004_3
(SEQ ID NO: 1194)
>G140962_k105_35121_2
(SEQ ID NO: 1198)
>G141002_k105_9813_5
(SEQ ID NO: 1202)
>G88780_k105_47792_2
(SEQ ID NO: 1206)
>ERR2017529_k103_7226_4
(SEQ ID NO: 1210)
>G141069_k105_86012_2
(SEQ ID NO: 1214)
>ERR2017521_k103_95312_16
(SEQ ID NO: 1218)
>G48793_k105_78735_2
(SEQ ID NO: 1222)
>MSM6J2JN_R_k105_26390_3
(SEQ ID NO: 1226)
>G35127_k105_167652
(SEQ ID NO: 1230)
>HSM7CZ36_R_k105_4760_16
(SEQ ID NO: 1234)
>G140963_k105_7582_3
(SEQ ID NO: 1091)
>ERR2017541_k103_4721_8
(SEQ ID NO: 1095)
>G140044_k105_50730_3
(SEQ ID NO: 1099)
>G104871_k105_77635_8
(SEQ ID NO: 1103)
>ERR2017519_k103_59931_10
(SEQ ID NO: 1107)
>G140884_k105_11480_2
(SEQ ID NO: 1111)
>G140783_k105_11631_1
(SEQ ID NO: 1115)
>G48780_k105_105879_11
(SEQ ID NO: 1119)
>G139954_k105_43288_2
(SEQ ID NO: 1123)
>ERR2017627_k103_1345_17
(SEQ ID NO: 1127)
>G36389_k105_24519_21
(SEQ ID NO: 1131)
>G140796_k105_31673_3
(SEQ ID NO: 1135)
>G105106_k105_73799_3
(SEQ ID NO: 1139)
>G141069_k105_58561_4
(SEQ ID NO: 1143)
>G88707_k105_59840_1
(SEQ ID NO: 1147)
>ERR2017697_k103_6305_6
(SEQ ID NO: 1151)
>G141033_k105_22846_2
(SEQ ID NO: 1155)
>G48842_k105_22347_3
(SEQ ID NO: 1159)
>G48792_k105_71109_5
(SEQ ID NO: 1163)
>ERR2017713_k103_83105_6
(SEQ ID NO: 1167)
>G48832_k105_34466_21
(SEQ ID NO: 1171)
>CSM79HHM_R_k105_36088_
(SEQ ID NO: 1175)
>G48841_k105_34004_4
(SEQ ID NO: 1179)
>G48790_k105_79570_10
(SEQ ID NO: 1183)
>G104950_k105_35992_3
(SEQ ID NO: 1187)
>G48819_k105_15450_22
(SEQ ID NO: 1191)
>G140127_k105_9689_199
(SEQ ID NO: 1195)
>G140847_k105_40774_49
(SEQ ID NO: 1199)
>G140862_k105_20065_4
(SEQ ID NO: 1203)
>G140835_k105_62319_2
(SEQ ID NO: 1207)
>G140117_k105_31657_47
(SEQ ID NO: 1211)
>CSM7KOON_R_k105_20482_2
(SEQ ID NO: 1215)
>ERR2017694_k103_130139_10
(SEQ ID NO: 1219)
>ERR2017591_k103_44083_2
(SEQ ID NO: 1223)
>G139955_k105_37242_1
(SEQ ID NO: 1227)
>ERR2017460_k93_8951_28
(SEQ ID NO: 1231)
>ERR2017522_k103_75403_15
(SEQ ID NO: 1235)
>G89274_k105_23131_2
(SEQ ID NO: 1092)
>ERR2017438_k93_17261_2
(SEQ ID NO: 1096)
>G72710_k105_18110_6
(SEQ ID NO: 1100)
>G48817_k105_98126_1
(SEQ ID NO: 1104)
>G141093_k105_17600_1
(SEQ ID NO: 1108)
>G140084_k105_29452_1
(SEQ ID NO: 1112)
>G140839_k105_1033_1
(SEQ ID NO: 1116)
>ERR2017450_k93_16033_43
(SEQ ID NO: 1120)
>G48817_k105_9493_7
(SEQ ID NO: 1124)
>G48812_k105_74869_4
(SEQ ID NO: 1128)
>MSM6J2ML_R_k105_5326_1
(SEQ ID NO: 1132)
>G140956_k105_4544_14
(SEQ ID NO: 1136)
>G48817_k105_184091_4
(SEQ ID NO: 1140)
>G48790_k105_187226_3
(SEQ ID NO: 1144)
>G140123_k105_19648_3
(SEQ ID NO: 1148)
>G140946_k105_5188_2
(SEQ ID NO: 1152)
>ERR2017541_k103_36965_3
(SEQ ID NO: 1156)
>ERR2017649_k103_23134_4
(SEQ ID NO: 1160)
>G72690_k105_43433_28
(SEQ ID NO: 1164)
>G48807_k105_78138_2
(SEQ ID NO: 1168)
>G48817_k105_96906_1
(SEQ ID NO: 1172)
>G36347_k105_21670_29
(SEQ ID NO: 1176)
>G140954_k105_94671_2
(SEQ ID NO: 1180)
>G105012_k105_23488_2
(SEQ ID NO: 1184)
>G48794_k105_122196_1
(SEQ ID NO: 1188)
>G140771_k105_65449_1
(SEQ ID NO: 1192)
>G36350_k105_2049_35
(SEQ ID NO: 1196)
>G48791_k105_90596_2
(SEQ ID NO: 1200)
>ERR2017660_k103_107940_2
(SEQ ID NO: 1204)
>G72682_k105_65246_2
(SEQ ID NO: 1208)
>ERR2017646_k103_51209_2
(SEQ ID NO: 1212)
>G139967_k105_51614_3
(SEQ ID NO: 1216)
>G48792_k105_56706_8
(SEQ ID NO: 1220)
>G140117_k105_1273_36
(SEQ ID NO: 1224)
>G48819_k105_16025_5
(SEQ ID NO: 1228)
>G141105_k105_63598_2
(SEQ ID NO: 1232)
>HSM7CYYB_R_k105_1319_54
(SEQ ID NO: 1236)

TABLE 8-continued

Protein sequences identifiers from the combined assembly that share at least 20% AA identity to ECOP170.

| | | | |
|---|---|---|---|
| >G104819_k105_86833_7 (SEQ ID NO: 1237) | >G48791_k105_86514_14 (SEQ ID NO: 1238) | >G72728_k105_70582_21 (SEQ ID NO: 1239) | >G48820_k105_6376_48 (SEQ ID NO: 1240) |
| >G88971_k105_7855_2 (SEQ ID NO: 1241) | >ERR2017631_k103_35716_2 (SEQ ID NO: 1242) | >ERR2017513_k79_22366_16 (SEQ ID NO: 1243) | >ERR2017631_k103_68539_5 (SEQ ID NO: 1244) |
| >G140046_k105_7512_1 (SEQ ID NO: 1245) | >G139999_k105_69212_4 (SEQ ID NO: 1246) | >ERR2017554_k103_9322_8 (SEQ ID NO: 1247) | >G48823_k105_22307_8 (SEQ ID NO: 1248) |
| >G89252_k105_71026_2 (SEQ ID NO: 1249) | >CSM79HH2_P_R_k105_46311_2 (SEQ ID NO: 1250) | >ESM5MEE6_P_R_k105_12293_2 (SEQ ID NO: 1251) | >ERR2017692_k103_64673_14 (SEQ ID NO: 1252) |
| >G72679_k105_11881_23 (SEQ ID NO: 1253) | >MSM5FZ9N_P_R_k105_3455_2 (SEQ ID NO: 1254) | >ERR2017705_k103_118784_17 (SEQ ID NO: 1255) | >PSMB4MBK_R_k105_12074_1 (SEQ ID NO: 1256) |
| >ERR2017581_k103_88831_2 (SEQ ID NO: 1257) | >G140194_k105_2179_5 (SEQ ID NO: 1258) | >G36374_k105_21299_5 (SEQ ID NO: 1259) | >ERR2017604_k103_65881_13 (SEQ ID NO: 1260) |
| >ERR2017468_k103_65700_23 (SEQ ID NO: 1261) | >G36362_k105_56067_1 ((SEQ ID NO: 1262) | >ERR2017604_k103_27454_1 (SEQ ID NO: 1263) | >ERR2017729_k103_147811_16 (SEQ ID NO: 1264) |
| >G89166_k105_51839_1 (SEQ ID NO: 1265) | >PSM7J19Z_R_k105_8383_1 (SEQ ID NO: 1266) | >ERR2017617_k103_31111_16 (SEQ ID NO: 1267) | >G36363_k105_19601_23 (SEQ ID NO: 1268) |
| >G48838_k105_87654_2 (SEQ ID NO: 1269) | >G140042_k105_46414_12 (SEQ ID NO: 1270) | >G140794_k105_14819_8 (SEQ ID NO: 1271) | >ERR2017632_k103_97161_4 (SEQ ID NO: 1272) |
| >G104848_k105_66284_59 (SEQ ID NO: 1273) | >G104834_k105_65261_6 (SEQ ID NO: 1274) | >G48790_k105_240741_28 (SEQ ID NO: 1275) | >G36358_k105_61218_22 (SEQ ID NO: 1276) |
| >G140918_k105_10126_15 (SEQ ID NO: 1277) | >G140926_k105_36262_33 (SEQ ID NO: 1278) | >ERR2017675_k103_63644_2 (SEQ ID NO: 1279) | >G140114_k105_14395_1 (SEQ ID NO: 1280) |
| >G139971_k105_108960_3 (SEQ ID NO: 1281) | >G141011_k105_17791_2 (SEQ ID NO: 1282) | >ERR2017699_k103_20019_15 (SEQ ID NO: 1283) | >MSM5ZOJY_P_R_k105_33180_2 (SEQ ID NO: 1284) |
| >G141820_k105_8524_11 (SEQ ID NO: 1285) | >G72705_k105_28979_30 (SEQ ID NO: 1286) | >G48806_k105_2407_249 (SEQ ID NO: 1287) | >G48791_k105_10965_35 (SEQ ID NO: 1288) |
| >ERR2017619_k103_60835_2 (SEQ ID NO: 1289) | >G105000_k105_71576_21 (SEQ ID NO: 1290) | >MSM6J2K6_R_k105_46998_1 (SEQ ID NO: 1291) | >MSM9VZF7_R_k105_23695_1 (SEQ ID NO: 1292) |
| >ERR2017715_k103_76704_238 (SEQ ID NO: 1293) | >ERR2017519_k103_62300_2 (SEQ ID NO: 1294) | >G104917_k105_57650_64 (SEQ ID NO: 1295) | >G140964_k105_18777_11 (SEQ ID NO: 1296) |
| >MSM6J2LL_R_k105_43260_4 (SEQ ID NO: 1297) | >CSM79HHM_R_k105_56064_17 (SEQ ID NO: 1298) | >HSMA33IE_R_k105_11891_7 (SEQ ID NO: 1299) | >G48819_k105_13887_2 (SEQ ID NO: 1300) |
| >G141071_k105_30476_1 (SEQ ID NO: 1301) | >ERR2017467_k103_104261_6 (SEQ ID NO: 1302) | >ERR2017450_k93_49825_2 (SEQ ID NO: 1303) | >CSM79HNI_R_k105_11987_6 (SEQ ID NO: 1304) |
| >ERR2017462_k103_108422_2 (SEQ ID NO: 1305) | >G48832_k105_113_4 (SEQ ID NO: 1306) | >G48839_k105_14226_103 (SEQ ID NO: 1307) | >ERR2017567_k103_35437_3 (SEQ ID NO: 1308) |
| >MSM9VZHZ_R_k105_22248_2 (SEQ ID NO: 1309) | >G88899_k105_40262_4 (SEQ ID NO: 1310) | >G88896_k105_43136_7 L (SEQ ID NO: 1311) | >ERR2017675_k103_2518_13 (SEQ ID NO: 1312) |
| >G88861_k105_1699_3 (SEQ ID NO: 1313) | >G88829_k105_5139_1 (SEQ ID NO: 1314) | >G36375_k105_17903_5 (SEQ ID NO: 1315) | >MSM9VZF7_R_k105_48462_235 (SEQ ID NO: 1316) |
| >G140099_k105_49983_2 (SEQ ID NO: 1317) | >G88910_k105_83216_3 (SEQ ID NO: 1318) | >G140010_k105_23406_12 (SEQ ID NO: 1319) | >ERR2017617_k103_22796_2 (SEQ ID NO: 1320) |
| >PSM7J161_R_k105_6364_1 (SEQ ID NO: 1321) | >ERR2017591_k103_14557_13 (SEQ ID NO: 1322) | >G72718_k105_87329_2 (SEQ ID NO: 1323) | >ERR2017467_k103_139125_2 (SEQ ID NO: 1324) |
| >CSM67UAA_R_k105_7898_82 (SEQ ID NO: 1325) | >HSM7CYY3_R_k105_7873_1 (SEQ ID NO: 1326) | >G140108_k105_20181_6 (SEQ ID NO: 1327) | >G140953_k105_120914_2 (SEQ ID NO: 1328) |
| >G141115_k105_109409_10 (SEQ ID NO: 1329) | >MSM9VZOS_R_k105_8640_5 L (SEQ ID NO: 1330) | >G72732_k105_65944_32 I (SEQ ID NO: 1331) | >G141013_k105_44163_3 (SEQ ID NO: 1332) |
| >HSM5MD5B_R_k105_31299_2 (SEQ ID NO: 1333) | >ERR2017574_k103_87688_6 (SEQ ID NO: 1334) | >G140778_k105_22917_3 (SEQ ID NO: 1335) | >G140842_k105_98923_2 (SEQ ID NO: 1336) |
| >G104945_k105_16762_21 (SEQ ID NO: 1337) | >ERR2017628_k103_39887_7 (SEQ ID NO: 1338) | >ERR2017659_k103_111452_5 (SEQ ID NO: 1339) | >ERR2017729_k103_96573_1 I (SEQ ID NO: 1340) |
| >ERR2017592_k103_5824_6 (SEQ ID NO: 1341) | >CSM67UAU_R_k105_11488_13 (SEQ ID NO: 1342) | >G48819_k105_16762_2 (SEQ ID NO: 1343) | >ERR2017658_k103_22266_4 (SEQ ID NO: 1344) |
| >ERR2017531_k103_7122_8 (SEQ ID NO: 1345) | >G139958_k105_15426_1 (SEQ ID NO: 1346) | >ERR2017576_k103_30046_58 (SEQ ID NO: 1347) | >G140829_k105_29833_4 (SEQ ID NO: 1348) |
| >ERR2017634_k103_114035_2 (SEQ ID NO: 1349) | >CSM79HQB_R_k105_43407_16 (SEQ ID NO: 1350) | >G48819_k105_8761_25 (SEQ ID NO: 1351) | >G141817_k105_62304_2 (SEQ ID NO: 1352) |
| >G88960_k105_14418_90 (SEQ ID NO: 1353) | >ERR2017540_k103_68543_4 (SEQ ID NO: 1354) | >ERR2017574_k103_35057_3 (SEQ ID NO: 1355) | >G48789_k105_149270_9 (SEQ ID NO: 1356) |
| >G104895_k105_11498_1 (SEQ ID NO: 1357) | >G104981_k105_100786_18 (SEQ ID NO: 13580) | >G72705_k105_5088_76 (SEQ ID NO: 1359) | >ERR2017665_k103_63019_2 (SEQ ID NO: 1360) |
| >ERR2017541_k103_79773_14 (SEQ ID NO: 1361) | >G104903_k105_38894_2 (SEQ ID NO: 1362) | >G48795_k105_91713_4 (SEQ ID NO: 1363) | >G140979_k105_3526_3 (SEQ ID NO: 1364) |
| >G104973_k105_14346_2 (SEQ ID NO: 1365) | >G105053_k105_605_1 (SEQ ID NO: 1366) | >ERR2017465_k103_80995_19 (SEQ ID NO: 1367) | >G72722_k105_58143_7 (SEQ ID NO: 1368) |
| >ERR2017539_k103_8528_3 (SEQ ID NO: 1369) | >G48790_k105_260684_12 (SEQ ID NO: 1370) | >G104987_k105_47329_7 (SEQ ID NO: 1371) | >G48841_k105_20232_2 (SEQ ID NO: 1372) |
| >MSM79H6H_R_k105_62198_2 (SEQ ID NO: 1373) | >ERR2017466_k103_51357_2 (SEQ ID NO: 1374) | >ERR2017528_k103_38552_58 (SEQ ID NO: 1375) | >G140004_k105_60738_19 (SEQ ID NO: 1376) |

TABLE 8-continued

Protein sequences identifiers from the combined assembly that share at least 20% AA identity to ECOP170.

| | | | |
|---|---|---|---|
| >G141820_k105_1664_7 (SEQ ID NO: 1377) | >G139991_k105_2956_3 (SEQ ID NO: 1378) | >ERR2017593_k103_73404_2 (SEQ ID NO: 1379) | >ERR2017676_k103_43858_84 (SEQ ID NO: 1380) |
| >G36375_k105_12579_7 (SEQ ID NO: 1381) | >ERR2017532_k103_111285_139 (SEQ ID NO: 1382) | >G48832_k105_52527_47 (SEQ ID NO: 1383) | >ERR2017592_k103_6902_21 (SEQ ID NO: 1384) |
| >ERR2017476_k79_78595_6 (SEQ ID NO: 1385) | >ERR2017577_k103_34879_2 (SEQ ID NO: 1386) | >CSM79HRC_R_k105_17222_4 (SEQ ID NO: 1387) | >E5M718V8_R_k105_32821_1 (SEQ ID NO: 1388) |
| >G140186_k105_34309_1 (SEQ ID NO: 1389) | >G89268_k105_89716_3 (SEQ ID NO: 1390) | >ERR2017596_k103_3269_7 (SEQ ID NO: 1391) | >G139971_k105_38132_9 (SEQ ID NO: 1392) |
| >G104818_k105_45893_2 (SEQ ID NO: 1393) | >G72701_k105_74492_2 (SEQ ID NO: 1394) | >CSM67U9H_P_R_k105_10905_3 (SEQ ID NO: 1395) | >G141819_k105_44854_4 (SEQ ID NO: 1396) |
| >G140180_k105_17929_2 (SEQ ID NO: 1397) | >G89190_k105_61505_2 (SEQ ID NO: 1398) | >ERR2017529_k103_16686_2 (SEQ ID NO: 1399) | >G48783_k105_11351_31 (SEQ ID NO: 1400) |
| >G140847_k105_1511_130 (SEQ ID NO: 1401) | >ERR2017618_k103_3529_14 (SEQ ID NO: 1402) | >ERR2017569_k103_48771_95 (SEQ ID NO: 1403) | >G141082_k105_46179_2 (SEQ ID NO: 1404) |
| >G105093_k105_60548_9 (SEQ ID NO: 1405) | >G140805_k105_73579_1 (SEQ ID NO: 1406) | >G89273_k105_100810_11 (SEQ ID NO: 1407) | >ERR2017729_k103_71253_23 (SEQ ID NO: 1408) |
| >G140000_k105_61667_2 (SEQ ID NO: 1409) | >PSM7J15Q_R_k105_5086_2 (SEQ ID NO: 1410) | >MSM79HAL_R_k105_20354_2 (SEQ ID NO: 1411) | >CSM5MCY8_R_k105_18625_2 (SEQ ID NO: 1412) |
| >G141818_k105_30919_10 (SEQ ID NO: 1413) | >ERR2017468_k103_8422_46 (SEQ ID NO: 1414) | >G48790_k105_42687_3 (SEQ ID NO: 1415) | >ERR2017541_k103_1333_35 (SEQ ID NO: 1416) |
| >G48841_k105_34449_26 (SEQ ID NO: 1417) | >G104824_k105_39681_1 (SEQ ID NO: 1418) | >ERR2017682_k103_7936_49 (SEQ ID NO: 1419) | >G141040_k105_86346_4 (SEQ ID NO: 1420) |
| >G140027_k105_19655_2 (SEQ ID NO: 1421) | >G140864_k105_25432_3 (SEQ ID NO: 1422) | >G141101_k105_37692_2 (SEQ ID NO: 1423) | >ERR2017573_k103_64762_4 (SEQ ID NO: 1424) |
| >ERR2017678_k103_147_33 (SEQ ID NO: 1425) | >G139991_k105_59268_1 (SEQ ID NO: 1426) | >G36370_k105_8751_39 (SEQ ID NO: 1427) | >G89054_k105_1721_14 (SEQ ID NO: 1428) |
| >ERR2017532_k103_56479_6 (SEQ ID NO: 1429) | >ERR2017589_k103_50590_2 (SEQ ID NO: 1430) | >G48836_k105_2452_2 (SEQ ID NO: 1431) | >G88935_k105_45458_3 (SEQ ID NO: 1432) |
| >G104926_k105_37453_1 (SEQ ID NO: 1433) | >HSM6XRS6_R_k105_1614_10 (SEQ ID NO: 1434) | >ERR2017466_k103_10370_2 (SEQ ID NO: 1435) | >ERR2017570_k103_12631_9 (SEQ ID NO: 1436) |
| >G88882_k105_9670_1 (SEQ ID NO: 1437) | >ERR2017639_k103_41282_3 (SEQ ID NO: 1438) | >G48791_k105_172039_1 (SEQ ID NO: 1439) | >G105065_k105_8237_9 (SEQ ID NO: 1440) |
| >G140083_k105_31440_2 (SEQ ID NO: 1441) | >ERR2017556_k103_84623_2 (SEQ ID NO: 1442) | >G89146_k105_48867_8 (SEQ ID NO: 1443) | >MSM79H87_R_k105_25507_1 (SEQ ID NO: 1444) |
| >G48839_k105_64127_10 (SEQ ID NO: 1445) | >G48812_k105_101265_1 (SEQ ID NO: 1446) | >ERR2017593_k103_58240_8 (SEQ ID NO: 1447) | >G141083_k105_30428_2 (SEQ ID NO: 1448) |
| >G48821_k105_1104_134 (SEQ ID NO: 1449) | >G72705_k105_67941_3 (SEQ ID NO: 1450) | >G36369_k105_7468_41 (SEQ ID NO: 1451) | >G141111_k105_77307_1 (SEQ ID NO: 1452) |
| >ERR2017535_k103_25292_2 (SEQ ID NO: 1453) | >G48798_k105_91248_2 (SEQ ID NO: 1454) | >ERR2017728_k103_26137_2 (SEQ ID NO: 1455) | >ERR2017636_k103_10295_101 (SEQ ID NO: 1456) |
| >G139987_k105_11001_9 (SEQ ID NO: 1457) | >G48793_k105_101096_2 (SEQ ID NO: 1458) | >HSM7CYZF_R_k105_11181_2 (SEQ ID NO: 1459) | >G36378_k105_21568_3 (SEQ ID NO: 1460) |
| >ERR2017457_k93_25557_5 (SEQ ID NO: 1461) | >ERR2017613_k103_25741_2 (SEQ ID NO: 1462) | >G48792_k105_43316_2 (SEQ ID NO: 1463) | >ERR2017667_k103_22283_2 (SEQ ID NO: 1464) |
| >G104823_k105_64038_2 (SEQ ID NO: 1465) | >HSM5MD6Q_R_k105_1102_42 (SEQ ID NO: 1466) | >G36347_k105_4301_2 (SEQ ID NO: 1467) | >G88845_k105_5494_1 (SEQ ID NO: 1468) |
| >ERR2017430_k93_8706_1 (SEQ ID NO: 1469) | >CSM79HNE_R_k105_6917_14 (SEQ ID NO: 1470) | >G48789_k105_111433_27 (SEQ ID NO: 1471) | >CSM79HNI_R_k105_14150_9 (SEQ ID NO: 1472) |
| >HSM7J4QZ_R_k105_31837_2 (SEQ ID NO: 1473) | >G140113_k105_46706_43 (SEQ ID NO: 1474) | >G48817_k105_181825_6 (SEQ ID NO: 1475) | >G105114_k105_10366_5 (SEQ ID NO: 1476) |
| >G140106_k105_9553_2 (SEQ ID NO: 1477) | >ERR2017564_k103_78038_2 (SEQ ID NO: 1478) | >ERR2017659_k103_92981_6 (SEQ ID NO: 1479) | >G141007_k105_3760_2 (SEQ ID NO: 1480) |
| >MSM5LLGD_P_R_k105_10400_3 (SEQ ID NO: 1481) | >MSM79H94_P_R_k105_2831_50 (SEQ ID NO: 1482) | >ERR2017713_k103_86273_10 (SEQ ID NO: 1483) | >G72685_k105_24728_3 (SEQ ID NO: 1484) |
| >MSM5LLE3_P_R_k105_3198_2 (SEQ ID NO: 1485) | >G48812_k105_88827_4 (SEQ ID NO: 1486) | >HSM7CYZ7_R_k105_6563_2 (SEQ ID NO: 1487) | >G141075_k105_28565_37 (SEQ ID NO: 1488) |
| >G105008_k105_101226_2 (SEQ ID NO: 1489) | >G72697_k105_41131_2 (SEQ ID NO: 1490) | >ERR2017553_k103_4307_36 (SEQ ID NO: 1491) | >G48806_k105_24850_2 (SEQ ID NO: 1492) |
| >ERR2017629_k103_21994_3 (SEQ ID NO: 1493) | >G140984_k105_43097_4 (SEQ ID NO: 1494) | >G36350_k105_10034_25 (SEQ ID NO: 1495) | >MSM79H81_R_k105_31273_4 (SEQ ID NO: 1496) |
| >G72733_k105_12944_3 (SEQ ID NO: 1497) | >ERR2017519_k103_1064_28 (SEQ ID NO: 1498) | >G72703_k105_26569_3 (SEQ ID NO: 1499) | >ERR2017674_k103_7838_14 (SEQ ID NO: 1500) |
| >G48823_k105_101998_3 (SEQ ID NO: 1501) | >G48817_k105_18221_3 (SEQ ID NO: 1502) | >G48821_k105_25306_6 (SEQ ID NO: 1503) | >ERR2017662_k103_81106_1 (SEQ ID NO: 1504) |
| >G48821_k105_1926_9 (SEQ ID NO: 1505) | >G104923_k105_5159_1 (SEQ ID NO: 1506) | >G104932_k105_62636_3 (SEQ ID NO: 1507) | >ERR2017620_k103_12629_42 (SEQ ID NO: 1508) |
| >G105029_k105_62044_2 (SEQ ID NO: 1509) | >ERR2017608_k103_2280_29 (SEQ ID NO: 1510) | >G88977_k105_52915_6 (SEQ ID NO: 1511) | >ERR2017611_k103_38262_22 (SEQ ID NO: 1512) |
| >ERR2017608_k103_30901_2 (SEQ ID NO: 1513) | >G140884_k105_38182_27 (SEQ ID NO: 1514) | >G140812_k105_24526_16 (SEQ ID NO: 1515) | >ERR2017631_k103_380_1 (SEQ ID NO: 1516) |
| >G89199_k105_12311_3 (SEQ ID NO: 1517) | >G141100_k105_40015_1 (SEQ ID NO: 1518) | >ERR2017555_k103_85037_15 (SEQ ID NO: 1519) | >G105114_k105_41340_2 (SEQ ID NO: 1520) |
| >MSM6J2LY_R_k105_12804_5 (SEQ ID NO: 1521) | >MSM6J2LW_R_k105_6849_1 (SEQ ID NO: 1522) | >ERR2017592_k103_10557_6 (SEQ ID NO: 1523) | >ERR2017643_k103_21045_3 (SEQ ID NO: 1524) |

TABLE 8-continued

Protein sequences identifiers from the combined assembly that share at least 20% AA identity to ECOP170.

| | | | |
|---|---|---|---|
| >ERR2017570_k103_33081_67 | >G88691_k105_48085_2 | >CSM5MCUK_P_R_k105_2644_3 | >ERR2017624_k103_39429_3 |
| (SEQ ID NO: 1525) | (SEQ ID NO: 1526) | (SEQ ID NO: 1527) | (SEQ ID NO: 1528) |
| >ERR2017413_k93_8044_86 | >G139992_k105_8489_19 | >G72678_k105_38070_58 | >CSM67UCK_R_k105_4721_2 |
| (SEQ ID NO: 1529) | (SEQ ID NO: 1530) | (SEQ ID NO: 1531) | (SEQ ID NO: 1532) |
| >G105053_k105_13898_1 | >G36372_k105_15897_3 | >ERR2017577_k103_97291_2 | >ERR2017653_k103_28720_3 |
| (SEQ ID NO: 1533) | (SEQ ID NO: 1534) | (SEQ ID NO: 1535) | (SEQ ID NO: 1536) |
| >G141049_k105_5901_1 | >ERR2017643_k103_82303_1 | >ERR2017417_k93_30693_2 | >G36361_k105_7007_9 |
| (SEQ ID NO: 1537) | (SEQ ID NO: 1538) | (SEQ ID NO: 1539) | (SEQ ID NO: 1540) |
| >ERR2017639_k103_29376_7 | >ERR2017662_k103_5798_7 | >G105117_k105_98511_3 | >ERR2017628_k103_93284_1 |
| (SEQ ID NO: 1541) | (SEQ ID NO: 1542) | (SEQ ID NO: 1543) | (SEQ ID NO: 1544) |
| >G140010_k105_57289_12 | >G140164_k105_6796_5 | >ERR2017579_k103_69277_14 | >ERR2017638_k103_35116_2 |
| (SEQ ID NO: 1545) | (SEQ ID NO: 1546) | (SEQ ID NO: 1547) | (SEQ ID NO: 1548) |
| >G89089_k105_4922_3 | >G140002_k105_35037_2 | >G140929_k105_22538_2 | >ERR2017618_k103_15195_6 |
| (SEQ ID NO: 1549) | (SEQ ID NO: 1550) | (SEQ ID NO: 1551) | (SEQ ID NO: 1552) |
| >HSMA33KS_R_k105_33081_1 | >ERR2017645_k103_68314_2 | >CSM5MCZ3_R_k105_53031_66 | >ERR2017713_k103_70887_3 |
| (SEQ ID NO: 1553) | (SEQ ID NO: 1554) | (SEQ ID NO: 1555) | (SEQ ID NO: 1556) |
| >ERR2017641_k103_93336_11 | >G140893_k105_29308_2 | >G89076_k105_12367_2 | >ERR2017576_k103_81965_3 |
| (SEQ ID NO: 1557) | (SEQ ID NO: 1558) | (SEQ ID NO: 1559) | (SEQ ID NO: 1560) |
| >ERR2017673_k103_2068_1 | >PSM7J14X_R_k105_38756_3 | >ERR2017462_k103_108003_1 | >G140853_k105_22916_3 |
| (SEQ ID NO: 1561) | (SEQ ID NO: 1562) | (SEQ ID NO: 1563) | (SEQ ID NO: 1564) |
| >G88975_k105_41619_1 | >G105059_k105_1027_2 | >G36357_k105_33008_25 | >ERR2017662_k103_110809_1 |
| (SEQ ID NO: 1565) | (SEQ ID NO: 1566) | (SEQ ID NO: 1567) | (SEQ ID NO: 1568) |
| >ERR2017579_k103_138612_5 | >G36361_k105_35924_12 | >ERR2017627_k103_6263_13 | >ERR2017640_k103_88107_4 |
| (SEQ ID NO: 1569) | (SEQ ID NO: 1570) | (SEQ ID NO: 1571) | (SEQ ID NO: 1572) |
| >ERR2017659_k103_123660_3 | >G105035_k105_44000_30 | >ERR2017478_k79_92921_5 | >G140028_k105_95793_2 |
| (SEQ ID NO: 1573) | (SEQ ID NO: 1574) | (SEQ ID NO: 1575) | (SEQ ID NO: 1576) |
| >G72720_k105_35517_1 | >G139998_k105_43619_2 | >G140946_k105_101605_4 | >ERR2017598_k103_141262_71 |
| (SEQ ID NO: 1577) | (SEQ ID NO: 1578) | (SEQ ID NO: 1579) | (SEQ ID NO: 1580) |
| >G140848_k105_69541_3 | >ERR2017576_k103_10527_2 | >G104934_k105_72385_2 | >ERR2017675_k103_25515_3 |
| (SEQ ID NO: 1581) | (SEQ ID NO: 1582) | (SEQ ID NO: 1583) | (SEQ ID NO: 1584) |
| >G141128_k105_2740_4 | >ERR2017540_k103_49610_4 | >G48822_k105_4160_2 | >ERR2017631_k103_87781_12 |
| (SEQ ID NO: 1585) | (SEQ ID NO: 1586) | (SEQ ID NO: 1587) | (SEQ ID NO: 1588) |
| >G105052_k105_26641_1 | >G141019_k105_3266_4 | >ERR2017673_k103_45139_2 | >G36361_k105_13715_2 |
| (SEQ ID NO: 1589) | (SEQ ID NO: 1590) | (SEQ ID NO: 1591) | (SEQ ID NO: 1592) |
| >G141056_k105_67185_1 | >G48783_k105_20535_1 | >ERR2017581_k103_111654_9 | >G104834_k105_41478_1 |
| (SEQ ID NO: 1593) | (SEQ ID NO: 1594) | (SEQ ID NO: 1595) | (SEQ ID NO: 1596) |
| >MSM79H9K_R_k105_1646_2 | >ERR2017611_k103_15290_2 | >PSM6XBTR_R_k105_22350_30 | >G140887_k105_60859_3 |
| (SEQ ID NO: 1597) | (SEQ ID NO: 1598) | (SEQ ID NO: 1599) | (SEQ ID NO: 1600) |
| >G88927_k105_52848_2 | >G104939_k105_14838_1 | >G89123_k105_8632_2 | >ERR2017639_k103_41642_3 |
| (SEQ ID NO: 1601) | (SEQ ID NO: 1602) | (SEQ ID NO: 1603) | (SEQ ID NO: 1604) |
| >ERR2017632_k103_98480_2 | >G36366_k105_22517_35 | >ERR2017599_k103_56131_22 | >ERR2017631_k103_66813_3 |
| (SEQ ID NO: 1605) | (SEQ ID NO: 1606) | (SEQ ID NO: 1607) | (SEQ ID NO: 1608) |
| >G36347_k105_11649_2 | >G140775_k105_88713_2 | >ERR2017686_k103_93964_6 | >G105114_k105_13509_13 |
| (SEQ ID NO: 1609) | (SEQ ID NO: 1610) | (SEQ ID NO: 1611) | (SEQ ID NO: 1612) |
| >ERR2017680_k103_24086_4 | >ERR2017651_k103_285_5 | >G105007_k105_70208_3 | >ERR2017614_k103_14363_1 |
| (SEQ ID NO: 1613) | (SEQ ID NO: 1614) | (SEQ ID NO: 1615) | (SEQ ID NO: 1616) |
| >G36361_k105_23481_2 | >G48807_k105_7616_4 | >HSM5MD4B_P_R_k105_8794_2 | >ERR2017631_k103_80875_6 |
| (SEQ ID NO: 1617) | (SEQ ID NO: 1618) | (SEQ ID NO: 1619) | (SEQ ID NO: 1620) |
| >ERR2017607_k103_771_7 | >G48806_k105_6474_2 | >MSM6J2MB_R_k105_24448_19 | >ERR2017673_k103_59386_3 |
| (SEQ ID NO: 1621) | (SEQ ID NO: 1622) | (SEQ ID NO: 1623) | (SEQ ID NO: 1624) |
| >G141094_k105_67169_2 | >G48796_k105_2386_1 | >G104868_k105_9417_1 | >ERR2017611_k103_4149_3 |
| (SEQ ID NO: 1625) | (SEQ ID NO: 1626) | (SEQ ID NO: 1627) | (SEQ ID NO: 1628) |
| >MSM6J2MH_R_k105_18056_1 | >ERR2017626_k103_17966_3 | >G141049_k105_41538_4 | >ERR2017639_k103_64959_1 |
| (SEQ ID NO: 1629) | (SEQ ID NO: 1630) | (SEQ ID NO: 1631) | (SEQ ID NO: 1632) |
| >G48787_k105_123364_2 | >MSM79H7Q_R_k105_52885_2 | >G140002_k105_45903_3 | >ERR2017662_k103_81113_1 |
| (SEQ ID NO: 1633) | (SEQ ID NO: 1634) | (SEQ ID NO: 1635) | (SEQ ID NO: 1636) |
| >G141087_k105_20650_2 | >G141007_k105_11427_62 | >ERR2017637_k103_4812_2 | >ERR2017726_k103_22993_21 |
| (SEQ ID NO: 1637) | (SEQ ID NO: 1638) | (SEQ ID NO: 1639) | (SEQ ID NO: 1640) |
| >G105079_k105_69894_2 | >G88761_k105_26629_15 | >ERR2017525_k103_126715_5 | >G140125_k105_53229_1 |
| (SEQ ID NO: 1641) | (SEQ ID NO: 1642) | (SEQ ID NO: 1643) | (SEQ ID NO: 1644) |
| >P5M7J12J_R_k105_5405_1 | >G104961_k105_85512_4 | >ERR2017485_k79_10812_2 | >G89055_k105_26750_8 |
| (SEQ ID NO: 1645) | (SEQ ID NO: 1646) | (SEQ ID NO: 1647) | (SEQ ID NO: 1648) |
| >G48792_k105_85120_7 | >G48789_k105_173715_2 | >ERR2017482_k79_97630_2 | >ERR2017520_k103_35629_7 |
| (SEQ ID NO: 1649) | (SEQ ID NO: 1650) | (SEQ ID NO: 1651) | (SEQ ID NO: 1652) |
| >PSMA2675_R_k105_1833_3 | >ERR2017507_k79_87156_3 | >G104864_k105_39055_5 | >G48789_k105_208170_8 |
| (SEQ ID NO: 1653) | (SEQ ID NO: 1654) | (SEQ ID NO: 1655) | (SEQ ID NO: 1656) |
| >G48807_k105_125840_2 | >G104834_k105_42339_23 | >ERR2017554_k103_54487_6 | >ERR2017641_k103_3944_2 |
| (SEQ ID NO: 1657) | (SEQ ID NO: 1658) | (SEQ ID NO: 1659) | (SEQ ID NO: 1660) |
| >PSM7J16F_R_k105_18438_2 | >G36380_k105_13375_15 | >ERR2017681_k103_83175_2 | >ERR2017522_k103_92373_2 |
| (SEQ ID NO: 1661) | (SEQ ID NO: 1662) | (SEQ ID NO: 1663) | (SEQ ID NO: 1664) |
| >G140027_k105_44962_7 | >G88962_k105_36994_4 | >G48814_k105_38343_143 | >ERR2017441_k93_27946_2 |
| (SEQ ID NO: 1665) | (SEQ ID NO: 1666) | (SEQ ID NO: 1667) | (SEQ ID NO: 1668) |
| >ERR2017661_k103_26588_8 | >G105040_k105_25904_18 | >G140911_k105_7832_3 | >ERR2017720_k103_279_5 |
| (SEQ ID NO: 1669) | (SEQ ID NO: 1670) | (SEQ ID NO: 1671) | (SEQ ID NO: 1672) |

TABLE 8-continued

Protein sequences identifiers from the combined assembly that share at least 20% AA identity to ECOP170.

| | | | |
|---|---|---|---|
| >CSM5MCX3_R_k105_456_2 (SEQ ID NO: 1673) | >G36387_k105_6608_1 (SEQ ID NO: 1674) | >G36349_k105_24981_2 (SEQ ID NO: 1675) | >G140114_k105_36158_1 (SEQ ID NO: 1676) |
| >CSM67UEW_TR_R_k105_27826_2 (SEQ ID NO: 1677) | >HSM6XRS6_R_k105_2394_2 (SEQ ID NO: 1678) | >ERR2017692_k103_59563_17 (SEQ ID NO: 1679) | >ERR2017698_k103_86960_2 (SEQ ID NO: 1680) |
| >G140911_k105_70382_53 (SEQ ID NO: 1681) | >G72703_k105_4320_10 (SEQ ID NO: 1682) | >G141070_k105_56169_3 (SEQ ID NO: 1683) | >CSM5MCZ3_R_k105_56890_20 (SEQ ID NO: 1684) |
| >G48789_k105_76032_1 (SEQ ID NO: 1685) | >CSM79HNW_R_k105_1180_6 (SEQ ID NO: 1686) | >G141038_k105_1355_2 (SEQ ID NO: 1687) | >G104913_k105_98027_2 (SEQ ID NO: 1688) |
| >G104973_k105_24055_21 (SEQ ID NO: 1689) | >G48793_k105_165811_2 (SEQ ID NO: 1690) | >G140062_k105_21215_9 (SEQ ID NO: 1691) | >G104825_k105_87732_1 (SEQ ID NO: 1692) |
| >G140175_k105_767_1 (SEQ ID NO: 1693) | >ERR2017531_k103_7041_2 (SEQ ID NO: 1694) | >G140935_k105_19864_1 (SEQ ID NO: 1695) | >ERR2017711_k103_60104_4 (SEQ ID NO: 1696) |
| >PSM6XBTT_R_k105_52087_2 (SEQ ID NO: 1697) | >HSMA33KS_R_k105_32797_1 (SEQ ID NO: 1698) | >G36368_k105_10498_26 (SEQ ID NO: 1699) | >G48819_k105_15227_376 (SEQ ID NO: 1700) |
| >G88872_k105_25872_1 (SEQ ID NO: 1701) | >ERR2017475_k79_17860_3 (SEQ ID NO: 1702) | >ERR2017577_k103_40458_5 (SEQ ID NO: 1703) | >G48777_k105_54242_12 (SEQ ID NO: 1704) |
| >ERR2017605_k103_112193_5 (SEQ ID NO: 1705) | >G36392_k105_54916_3 (SEQ ID NO: 1706) | >ERR2017658_k103_54515_4 (SEQ ID NO: 1707) | >G141047_k105_73005_3 (SEQ ID NO: 1708) |
| >G48831_k105_35349_54 (SEQ ID NO: 1709) | >G139981_k105_75402_14 (SEQ ID NO: 1710) | >G48839_k105_38564_78 (SEQ ID NO: 1711) | >G48780_k105_9281_60 (SEQ ID NO: 1712) |
| >ERR2017618_k103_5325_51 (SEQ ID NO: 1713) | >ERR2017609_k103_24441_1 (SEQ ID NO: 1714) | >ERR2017615_k103_32102_3 (SEQ ID NO: 1715) | >ERR2017602_k103_53264_2 (SEQ ID NO: 1716) |
| >G48793_k105_55407_3 (SEQ ID NO: 1717) | >G105053_k105_36503_23 (SEQ ID NO: 1718) | >ERR2017529_k103_320_16 (SEQ ID NO: 1719) | >G104886_k105_52538_2 (SEQ ID NO: 1720) |
| >CSM79HOX_R_k105_6492_2 (SEQ ID NO: 1721) | >G36394_k105_47440_1 (SEQ ID NO: 1722) | >ERR2017615_k103_14852_1 (SEQ ID NO: 1723) | >ERR2017534_k103_104387_3 M (SEQ ID NO: 1724) |
| >G139982_k105_60115_1 (SEQ ID NO: 1725) | >HSM67VFX_P_R_k105_36206_2 (SEQ ID NO: 1726) | >G48806_k105_6646_5 (SEQ ID NO: 1727) | >G141013_k105_56626_1 (SEQ ID NO: 1728) |
| >ERR2017458_k93_57576_38 (SEQ ID NO: 1729) | >G139960_k105_56547_1 (SEQ ID NO: 1730) | >ERR2017716_k103_34026_6 (SEQ ID NO: 1731) | >MSM6J2HP_R_k105_26003_9 (SEQ ID NO: 1732) |
| >G140130_k105_47779_27 (SEQ ID NO: 1733) | >G140142_k105_28340_2 (SEQ ID NO: 1734) | >G140878_k105_1326_2 (SEQ ID NO: 1735) | >G48817_k105_145263_2 (SEQ ID NO: 1736) |
| >ERR2017720_k103_2159_4 (SEQ ID NO: 1737) | >ERR2017576_k103_48025_66 (SEQ ID NO: 1738) | >G104845_k105_18262_6 (SEQ ID NO: 1739) | >G36363_k105_20747_22 (SEQ ID NO: 1740) |
| >CSM5MCX3_R_k105_2746_1 (SEQ ID NO: 1741) | >HSM5MD7U_R_k105_10271_2 (SEQ ID NO: 1742) | >G105008_k105_5991_3 (SEQ ID NO: 1743) | >ERR2017602_k103_62451_1 (SEQ ID NO: 1744) |
| >G72729_k105_121335_1 (SEQ ID NO: 1745) | >ERR2017707_k103_129_1 (SEQ ID NO: 1746) | >G104929_k105_31220_4 (SEQ ID NO: 1747) | >G48790_k105_120264_12 (SEQ ID NO: 1748) |
| >G48790_k105_15366_16 (SEQ ID NO: 1749) | >ERR2017648_k103_43517_8 (SEQ ID NO: 1750) | >ERR2017611_k103_15650_15 (SEQ ID NO: 1751) | >ERR2017638_k103_84845_5 (SEQ ID NO: 1752) |
| >G141100_k105_58729_3 (SEQ ID NO: 1753) | >ERR2017700_k103_51831_9 (SEQ ID NO: 1754) | >G140785_k105_75533_3 (SEQ ID NO: 1755) | >G88838_k105_81324_2 (SEQ ID NO: 1756) |
| >G88881_k105_12287_8 (SEQ ID NO: 1757) | >G140963_k105_60434_10 (SEQ ID NO: 1758) | >G48791_k105_75277_1 (SEQ ID NO: 1759) | >G105069_k105_35867_2 (SEQ ID NO: 1760) |
| >ERR2017684_k103_39976_1 (SEQ ID NO: 1761) | >G88802_k105_7027_3 (SEQ ID NO: 1762) | >G48793_k105_17157_96 (SEQ ID NO: 1763) | >G104945_k105_62722_14 (SEQ ID NO: 1764) |
| >ERR2017551_k103_24348_2 (SEQ ID NO: 1765) | >ERR2017562_k103_235_1 (SEQ ID NO: 1766) | >ERR2017696_k103_644_25 (SEQ ID NO: 1767) | >ERR2017668_k103_94539_1 (SEQ ID NO: 1768) |
| >G48826_k105_121634_114 (SEQ ID NO: 1769) | >ERR2017546_k103_45747_2 (SEQ ID NO: 1770) | >ERR2017622_k103_106811_93 (SEQ ID NO: 1771) | >G72722_k105_89343_1 (SEQ ID NO: 1772) |
| >G140994_k105_16303_2 (SEQ ID NO: 1773) | >G48791_k105_146334_1 (SEQ ID NO: 1774) | >G141100_k105_10713_3 (SEQ ID NO: 1775) | >G105108_k105_50921_2 (SEQ ID NO: 1776) |
| >ERR2017688_k103_101386_9 (SEQ ID NO: 1777) | >CSM67UAA_R_k105_4547_2 (SEQ ID NO: 1778) | >ERR2017600_k103_37265_2 (SEQ ID NO: 1779) | >G104910_k105_55912_2 (SEQ ID NO: 1780) |
| >ERR2017461_k103_7903_2 (SEQ ID NO: 1781) | >G48799_k105_13424_3 (SEQ ID NO: 1782) | >PSMB4MBK_R_k105_2030_5 (SEQ ID NO: 1783) | >G140776_k105_17588_1 (SEQ ID NO: 1784) |
| >G36347_k105_12488_64 (SEQ ID NO: 1785) | >ERR2017686_k103_86463_6 (SEQ ID NO: 1786) | >G140185_k105_61550_6 (SEQ ID NO: 1787) | >ERR2017649_k103_49669_2 (SEQ ID NO: 1788) |
| >G36356_k105_71558_12 (SEQ ID NO: 1789) | >CSM5FZ3Z_P_R_k105_21061_2 (SEQ ID NO: 1790) | >CSM7KOMT_R_k105_28504_3 (SEQ ID NO: 1791) | >ERR2017545_k103_29168_2 (SEQ ID NO: 1792) |
| >G48780_k105_14908_2 (SEQ ID NO: 1793) | >G72705_k105_59825_14 (SEQ ID NO: 1794) | >G36370_k105_6051_96 (SEQ ID NO: 1795) | >G105115_k105_101906_2 (SEQ ID NO: 1796) |
| >G48802_k105_5208_71 (SEQ ID NO: 1797) | >G48840_k105_27043_12 (SEQ ID NO: 1798) | >G72690_k105_32079_52 (SEQ ID NO: 1799) | >G48790_k105_4930_3 (SEQ ID NO: 1800) |
| >ERR2017619_k103_10162_2 (SEQ ID NO: 1801) | >ERR2017636_k103_10144_7 (SEQ ID NO: 1802) | >G140004_k105_42470_1 (SEQ ID NO: 1803) | >G88749_k105_59786_2 (SEQ ID NO: 1804) |
| >G141113_k105_118013_6 (SEQ ID NO: 1805) | >MSM5LLEP_R_k105_12272_24 (SEQ ID NO: 1806) | >G48807_k105_45178_5 (SEQ ID NO: 1807) | >ERR2017680_k103_8033_36 (SEQ ID NO: 1808) |
| >G140134_k105_88254_18 (SEQ ID NO: 1809) | >ERR2017499_k103_47195_7 (SEQ ID NO: 1810) | >G140088_k105_106610_2 (SEQ ID NO: 1811) | >G104949_k105_52018_2 (SEQ ID NO: 1812) |
| >CSM79HJI_P_R_k105_17388_4 (SEQ ID NO: 1813) | >G72673_k105_23034_1 (SEQ ID NO: 1814) | >G36362_k105_67656_2 (SEQ ID NO: 1815) | >G140123_k105_32078_1 (SEQ ID NO: 1816) |

TABLE 8-continued

Protein sequences identifiers from the combined assembly that share at least 20% AA identity to ECOP170.

| | | | |
|---|---|---|---|
| >ERR2017624_k103_11821_2 (SEQ ID NO: 1817) | >G48832_k105_34431_20 (SEQ ID NO: 1818) | >ERR2017643_k103_56845_13 (SEQ ID NO: 1819) | >G89185_k105_61177_1 (SEQ ID NO: 1820) |
| >G48793_k105_55427_2 (SEQ ID NO: 1821) | >G72716_k105_24937_2 (SEQ ID NO: 1822) | >G140004_k105_69058_5 (SEQ ID NO: 1823) | >G88870_k105_21701_1 (SEQ ID NO: 1824) |
| >ERR2017460_k93_22250_1 (SEQ ID NO: 1825) | >G140198_k105_80297_1 (SEQ ID NO: 1826) | >G48790_k105_116212_2 (SEQ ID NO: 1827) | >G105029_k105_87332_1 (SEQ ID NO: 1828) |
| >CSM7KOS7_R_k105_6489_46 (SEQ ID NO: 1829) | >PSM7J15A_R_k105_10152_2 (SEQ ID NO: 1830) | >G48780_k105_5632_22 (SEQ ID NO: 1831) | >ERR2017549_J103_76007_8 (SEQ ID NO: 1832) |
| >G104941_k105_56765_2 (SEQ ID NO: 1833) | >ERR2017628_k103_89324_2 (SEQ ID NO: 1834) | >G48817_k105_74075_5 (SEQ ID NO: 1835) | >G104937_k105_52467_1 (SEQ ID NO: 1836) |
| >G140109_k105_58927_1 (SEQ ID NO: 1837) | >ERR2017704_k103_111078_1 (SEQ ID NO: 1838) | >ERR2017693_k103_28111_10 (SEQ ID NO: 1839) | >G140775_k105_36275_3 (SEQ ID NO: 1840) |
| >G104946_k105_16056_29 (SEQ ID NO: 1841) | >G48839_k105_61769_6 (SEQ ID NO: 1842) | >G89065_k105_21198_7 (SEQ ID NO: 1843) | >ERR2017528_k103_60282_14 (SEQ ID NO: 1844) |
| >G89182_k105_59201_11 (SEQ ID NO: 1845) | >G139981_k105_33639_1 (SEQ ID NO: 1846) | >CSM5MCZD_R_k105_43999_2 (SEQ ID NO: 1847) | >G140997_k105_35665_5 (SEQ ID NO: 1848) |
| >G140899_k105_58156_2 (SEQ ID NO: 1849) | >G48791_k105_52020_2 (SEQ ID NO: 1850) | >G141011_k105_85952_7 (SEQ ID NO: 1851) | >ERR2017598_k103_113995_3 (SEQ ID NO: 1852) |
| >G139981_k105_87138_2 (SEQ ID NO: 1853) | >MSM9VZIY_R_k105_14291_5 (SEQ ID NO: 1854) | >ERR2017546_k103_19428_5 (SEQ ID NO: 1855) | >HSM5MD53_R_k105_1522_8 (SEQ ID NO: 1856) |
| >MSM79HF7_R_k105_56275_7 (SEQ ID NO: 1857) | >G105114_k105_12242_2 (SEQ ID NO: 1858) | >G48806_k105_14918_94 (SEQ ID NO: 1859) | >G48817_k105_32541_37 (SEQ ID NO: 1860) |
| >G140941_k105_26650_24 (SEQ ID NO: 1861) | >ERR2017678_k103_8421_1 (SEQ ID NO: 1862) | >PSMB4MBK_R_k105_47933_2 (SEQ ID NO: 1863) | >G141119_k105_18175_1 (SEQ ID NO: 1864) |
| >G88846_k105_59291_2 (SEQ ID NO: 1865) | >G141820_k105_32546_5 (SEQ ID NO: 1866) | >ERR2017579_k103_130085_3 (SEQ ID NO: 1867) | >ERR2017673_k103_131688_1 (SEQ ID NO: 1868) |
| >ERR2017622_k103_105984_114 (SEQ ID NO: 1869) | >G141819_k105_8524_2 (SEQ ID NO: 1870) | >G139989_k105_81433_6 (SEQ ID NO: 1871) | >G36387_k105_11202_1 (SEQ ID NO: 1872) |
| >G141004_k105_14994_12 (SEQ ID NO: 1873) | >G139955_k105_34945_86 (SEQ ID NO: 1874) | >G88847_k105_17327_2 (SEQ ID NO: 1875) | >G88708_k105_510_1 (SEQ ID NO: 1876) |
| >ERR2017460_k93_5217_6 (SEQ ID NO: 1877) | >G72704_k105_26791_2 (SEQ ID NO: 1878) | >ERR2017644_k103_67649_37 (SEQ ID NO: 1879) | >ERR2017540_k103_42745_1 (SEQ ID NO: 1880) |
| >G140829_k105_55892_2 (SEQ ID NO: 1881) | >G104846_k105_38173_5 (SEQ ID NO: 1882) | >G48807_k105_94506_2 (SEQ ID NO: 1883) | >G48819_k105_1753_164 (SEQ ID NO: 1884) |
| >G140009_k105_42826_4 (SEQ ID NO: 1885) | >G88903_k105_18037_3 (SEQ ID NO: 1886) | >ERR2017651_k103_46482_137 (SEQ ID NO: 1887) | >MSM9VZIY_R_k105_2858_10 (SEQ ID NO: 1888) |
| >PSM7J12V_R_k105_8672_7 (SEQ ID NO: 1889) | >ERR2017574_k103_25700_5 (SEQ ID NO: 1890) | >G48817_k105_201956_3 (SEQ ID NO: 1891) | >ERR2017697_k103_36639_1 (SEQ ID NO: 1892) |
| >G141094_k105_83047_2 (SEQ ID NO: 1893) | >PSM7J15M_R_k105_1235_3 (SEQ ID NO: 1894) | >G36387_k105_17027_2 (SEQ ID NO: 1895) | >G88797_k105_19320_2 (SEQ ID NO: 1896) |
| >G48792_k105_157266_20 (SEQ ID NO: 1897) | >ERR2017725_k103_15488_3 (SEQ ID NO: 1898) | >ERR2017682_k103_21803_1 (SEQ ID NO: 1899) | >ERR2017613_k103_40340_1 (SEQ ID NO: 1900) |
| >G89146_k105_42388_2 (SEQ ID NO: 1901) | >G140786_k105_9825_2 (SEQ ID NO: 1902) | >G48817_k105_101466_2 (SEQ ID NO: 1903) | >G105024_k105_41543_4 (SEQ ID NO: 1904) |
| >G72723_k105_42742_2 (SEQ ID NO: 1905) | >G140099_k105_23605_3 (SEQ ID NO: 1906) | >G72701_k105_37191_6 (SEQ ID NO: 1907) | >G48790_k105_60374_4 (SEQ ID NO: 1908) |
| >G140028_k105_55234_7 (SEQ ID NO: 1909) | >ERR2017499_k103_44348_5 (SEQ ID NO: 1910) | >G48817_k105_101539_6 (SEQ ID NO: 1911) | >G140976_k105_46880_6 (SEQ ID NO: 1912) |
| >G48817_k105_10718_12 (SEQ ID NO: 1913) | >G36361_k105_31302_2 (SEQ ID NO: 1914) | >MSM79HDE_R_k105_18251_9 (SEQ ID NO: 1915) | >ERR2017580_k103_44400_2 (SEQ ID NO: 1916) |
| >G104885_k105_4212_10 (SEQ ID NO: 1917) | >ERR2017456_k103_59670_3 (SEQ ID NO: 1918) | >CSM9X222_R_k105_47383_2 (SEQ ID NO: 1919) | >G139981_k105_10447_2 (SEQ ID NO: 1920) |
| >MSM79H81_R_k105_2813_5 (SEQ ID NO: 1921) | >ERR2017519_k103_41937_3 (SEQ ID NO: 1922) | >ERR2017659_k103_161416_10 (SEQ ID NO: 1923) | >G140001_k105_81535_1 (SEQ ID NO: 1924) |
| >G48812_k105_9194_1 (SEQ ID NO: 1925) | >G48840_k105_54880_2 (SEQ ID NO: 1926) | >ERR2017560_k103_38773_6 (SEQ ID NO: 1927) | >HSM7CZ1C_R_k105_20468_2 (SEQ ID NO: 1928) |
| | | | >G48820_k105_15464_23 (SEQ ID NO: 1929) |
| | | | >ERR2017652_k103_98787_1 (SEQ ID NO: 1930) |

Figure 2A:
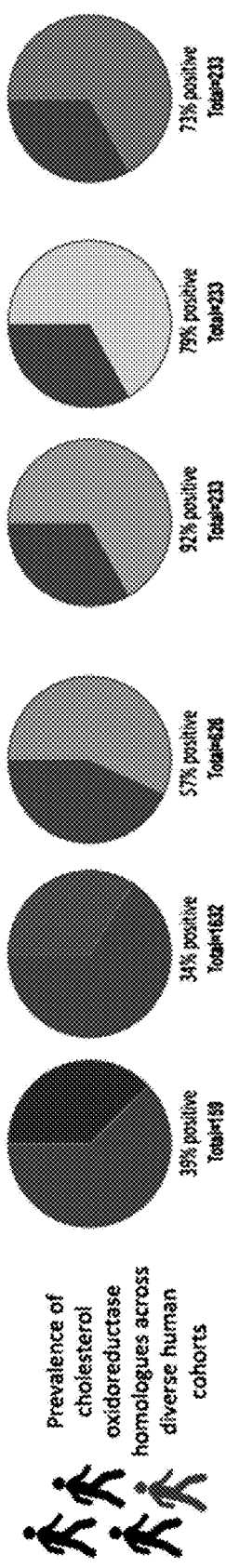
Figure 13A:
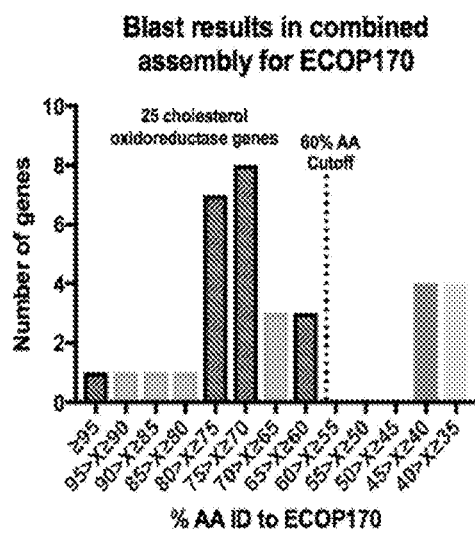
FIG. 13A-13C Identification of human-associated cholesterol oxidoreductases with homology to ECOP170 in the combined assembly of 7 human cohorts.
Figure 13B:
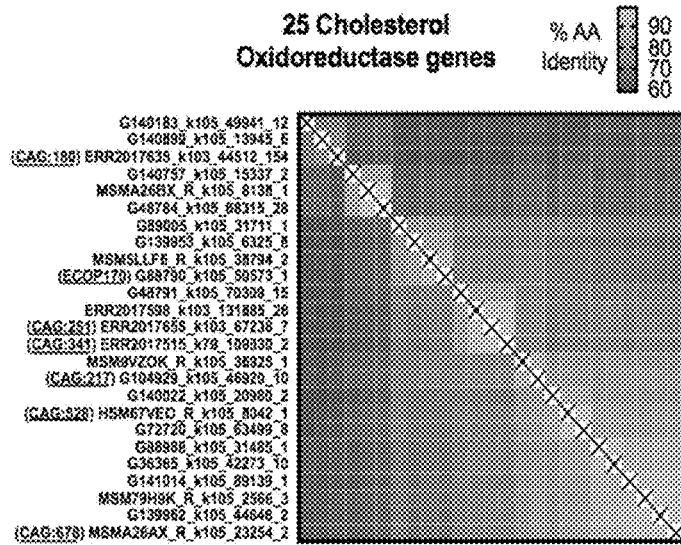
Figure 13C:
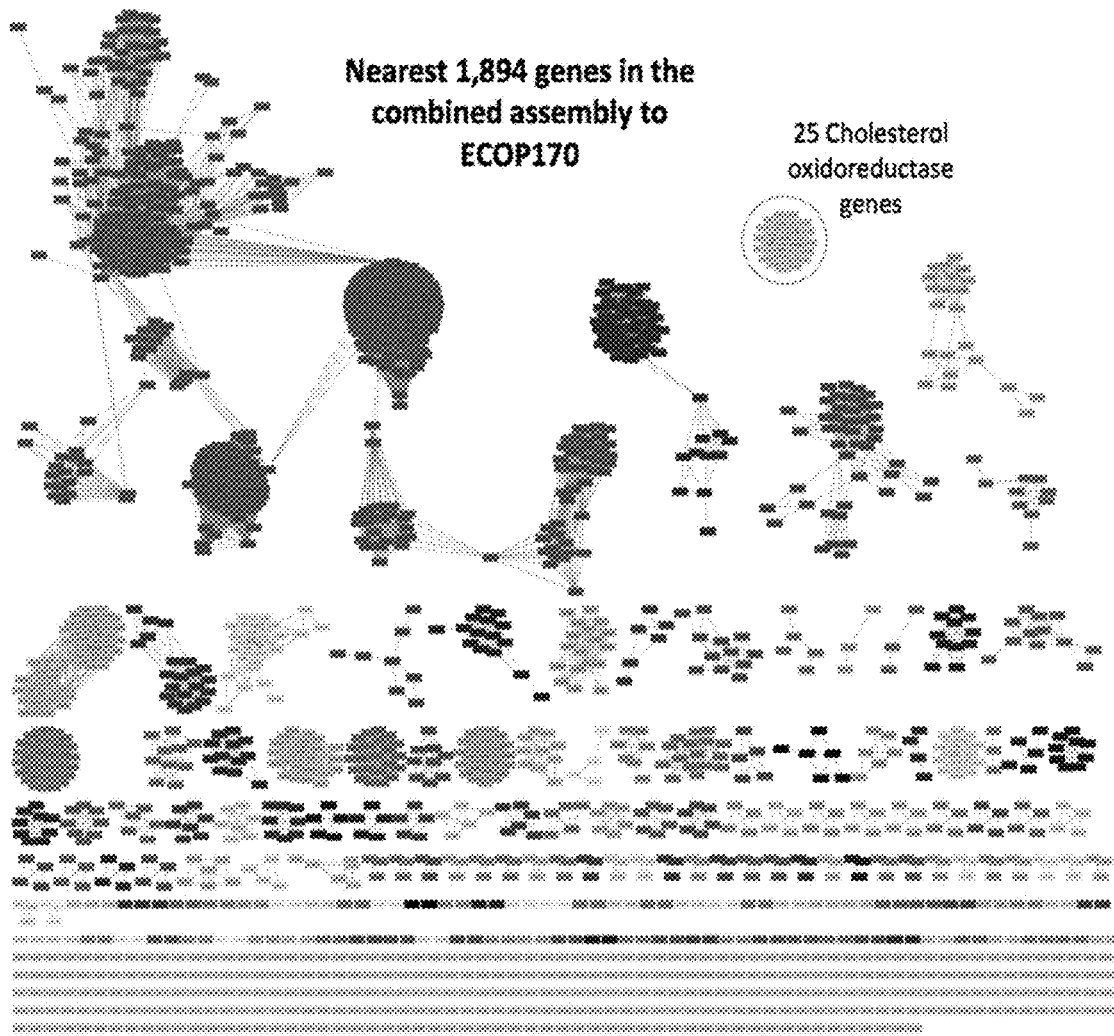
Figure 14A:
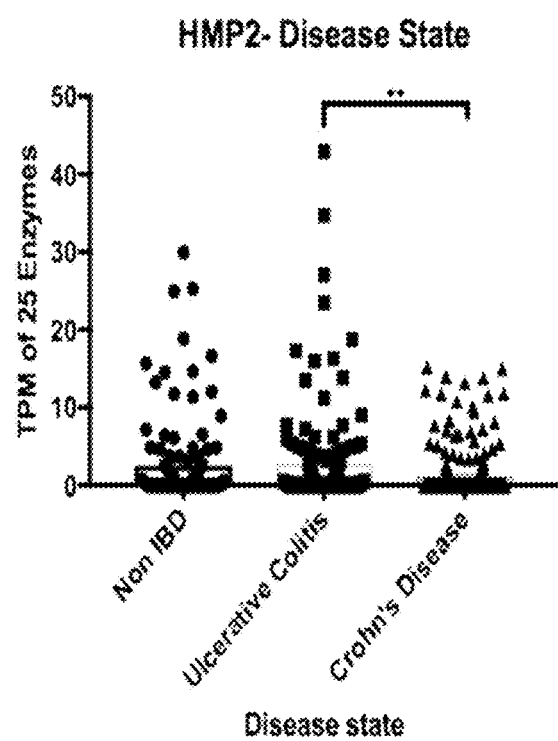
FIG. 14A-14B Effect of inflammatory bowel disease state and antibiotic usage on presence of cholesterol oxidoreductase in a microbiome in the HMP2 cohort.
Figure 14B:
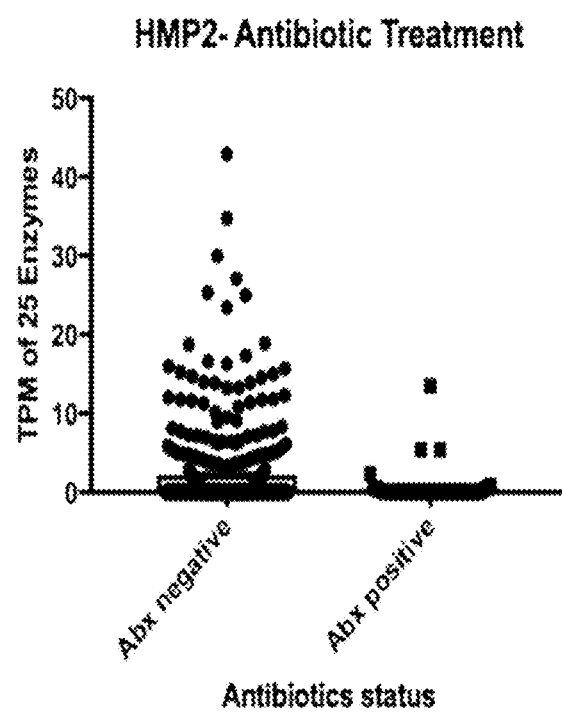

After discovering the human gut bacterial-associated CORs capable of metabolizing cholesterol, Applicants wanted to understand their prevalence, geographic distribution and diversity within human populations. To this end, Applicants assembled multiple gut metagenomic datasets from different locations around the world (N=3,142, FIG. 2A), resulting in 5,929,528 non-redundant complete genes (Table 8). Applicants identified 25 enzymes with at least 60% amino acid identity to ECOP170, including the 10 enzymes from the NCBI non-redundant protein database shown in FIG. 1C (FIG. 13A-13C, Table 1, Table 9). To understand the distribution of each of the 25 COR homologs in the human gut, Applicants stringently mapped the metagenomic datasets to the gene catalogue and calculated the prevalence and relative abundance of the individual genes in each dataset. Across these six cohorts, the percentage of samples positive for a COR homolog varied from 34% of samples in the Human Microbiome Project 2 (HMP2) cohort to 92% of samples in the CVON cohort (FIG. 2A). The two cohorts with the lowest percentage of enzyme encoders were PRISM and HMP2, both of which contain significant numbers of samples from inflammatory bowel disease (IBD) patients who have a history of antibiotic usage. In these two IBD cohorts Applicants found that Crohn's disease and antibiotic treatment were both significantly associated with depletion of CORs, suggesting that microbes that encode this enzyme may be sensitive to terminal ileum inflammation and/or antibiotics (FIG. 2C, 2D), 2E, FIG. 14A-141B).

TABLE 9

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G88790_k105_50573_1 | 99.30% | 575.859 | 0 | 100.00% | ECOP170 closest relative |
| MSM5LLF6_R_k105_38794_2 | 93.50% | 551.592 | 0 | 100.00% | |
| G139953_k105_6325_8 | 86.00% | 509.605 | 0 | 100.00% | |
| G89005_k105_31711_1 | 82.20% | 484.567 | 6.52E-175 | 98.92% | |
| G104929_k105_46920_10 | 79.00% | 460.299 | 2.86E-165 | 98.92% | CAG: 217 |
| MSM9VZOKR_k105_36925_1 | 78.30% | 455.292 | 2.80E-163 | 98.92% | |
| G140022_k105_20980_2 | 75.30% | 450.284 | 2.82E-161 | 100.00% | |
| ERR2017598_k103_131885_26 | 75.20% | 448.743 | 1.26E-160 | 100.00% | |
| G48791_k105_70309_15 | 77.50% | 448.743 | 1.28E-160 | 98.57% | |
| ERR2017655_k103_67238_7 | 77.10% | 447.973 | 2.97E-160 | 98.57% | CAG: 251 |
| ERR2017515_k79_109830_2 | 76.70% | 446.817 | 6.67E-160 | 98.57% | CAG: 341 |
| HSM67VEO_R_k105_8042_1 | 74.60% | 445.662 | 1.57E-159 | 100.00% | CAG: 528 |
| G72720_k105_63499_8 | 74.20% | 445.277 | 2.59E-159 | 100.00% | |
| G141014_k105_89139_1 | 73.50% | 438.343 | 1.17E-156 | 98.57% | |
| G36365_k105_42273_10 | 73.80% | 434.876 | 3.32E-155 | 98.57% | |
| G88988_k105_31485_1 | 73.50% | 431.795 | 4.97E-154 | 98.57% | |
| G139962_k105_44646_2 | 71.60% | 429.869 | 2.95E-153 | 98.57% | |
| MSMA26AX_R_k105_23254_2 | 71.60% | 429.483 | 3.29E-153 | 98.57% | CAG: 678 |
| MSM79H9K_R_k105_2566_3 | 72.40% | 429.483 | 4.05E-153 | 98.57% | |
| MSMA26BX_R_k105_8138_1 | 67.60% | 389.037 | 3.38E-137 | 98.57% | |
| G48784_k105_68315_28 | 67.30% | 388.652 | 4.64E-137 | 98.57% | |
| G140757_k105_15337_2 | 65.50% | 374.785 | 1.34E-131 | 98.57% | |
| G140899_k105_13945_6 | 61.30% | 359.377 | 1.47E-125 | 100.00% | |
| ERR2017635_k103_44512_154 | 60.20% | 353.214 | 3.52E-123 | 100.00% | CAG: 180 |
| G140183_k105_49941_12 | 60.90% | 341.273 | 2.32E-118 | 100.00% | |
| ERR2017692_k103_50246_1 | 41.80% | 229.95 | 6.26E-75 | 97.49% | |
| ERR2017664_k103_46392_10 | 41.80% | 226.868 | 9.26E-74 | 97.49% | |
| G36358_k105_12421_117 | 43.20% | 210.69 | 1.53E-67 | 97.49% | |
| G48792_k105_39954_4 | 40.00% | 201.445 | 7.43E-64 | 99.28% | |
| G48817_k105_185451_55 | 38.50% | 191.43 | 8.37E-60 | 97.85% | |
| G140963_k105_17761_2 | 39.40% | 184.882 | 1.53E-57 | 98.92% | |
| G140839_k105_38876_2 | 36.90% | 176.407 | 5.39E-54 | 96.77% | |
| G48790_k105_239255_7 | 36.80% | 166.777 | 1.70E-50 | 98.57% | |
| MSM5FZA2_P_R_k105_41796_2 | 32.10% | 112.849 | 2.48E-30 | 90.68% | |
| G105091_k105_21628_1 | 31.70% | 111.694 | 6.70E-30 | 93.19% | |
| G140839_k105_7117_2 | 31.40% | 110.153 | 2.29E-29 | 96.42% | |
| G48798_k105_49523_6 | 30.20% | 108.227 | 9.64E-29 | 92.11% | |
| G140035_k105_98244_2 | 28.70% | 108.227 | 9.93E-29 | 96.77% | |
| G140887_k105_41000_3 | 31.30% | 108.612 | 1.18E-28 | 93.55% | |
| G140077_k105_8391_2 | 30.20% | 107.457 | 1.72E-28 | 93.19% | |
| G105016_k105_27408_1 | 37.10% | 104.375 | 1.54E-27 | 68.46% | |
| G48790_k105_174727_16 | 28.10% | 103.219 | 6.27E-27 | 96.42% | |
| ERR2017564_k103_99141_2 | 28.70% | 103.219 | 7.09E-27 | 96.77% | |
| G36387_k105_6608_1 | 31.60% | 99.7525 | 7.52E-26 | 75.63% | |
| G141060_k105_19626_5 | 29.80% | 98.9821 | 1.43E-25 | 84.95% | |
| G139981_k105_7602_2 | 28.40% | 99.3673 | 1.55E-25 | 93.19% | |
| ERR2017646_k103_51209_2 | 30.50% | 98.5969 | 1.90E-25 | 68.10% | |
| G36347_k105_4301_2 | 29.70% | 98.5969 | 2.06E-25 | 80.65% | |
| MSM79H54_R_k105_50312_159 | 29.20% | 98.9821 | 2.08E-25 | 93.19% | |
| G140130_k105_69611_14 | 30.50% | 97.8265 | 4.20E-25 | 93.19% | |
| PSM7J1BP_R_k105_3311_3 | 32.70% | 97.4413 | 5.01E-25 | 69.53% | |
| G48793_k105_78735_2 | 31.90% | 96.6709 | 8.82E-25 | 67.03% | |
| CSM79HH2_P_R_k105_46311_2 | 37.90% | 96.6709 | 9.71E-25 | 67.38% | |
| G48789_k105_173715_2 | 33.20% | 96.2857 | 1.20E-24 | 71.68% | |
| CSM5MCZ3_R_k105_56890_20 | 29.70% | 95.9005 | 1.27E-24 | 82.44% | |
| G72701_k105_74492_2 | 32.70% | 96.2857 | 1.45E-24 | 69.53% | |
| G140839_k105_60449_2 | 36.00% | 95.9005 | 1.59E-24 | 67.38% | |
| G104824_k105_28491_2 | 28.90% | 95.9005 | 2.32E-24 | 92.11% | |
| G140164_k105_54779_1 | 35.80% | 95.1301 | 2.85E-24 | 67.38% | |
| HSM67VFX_P_R_k105_42292_1 | 29.50% | 95.1301 | 2.96E-24 | 68.10% | |
| ERR2017611_k103_15290_2 | 30.50% | 95.1301 | 3.20E-24 | 72.04% | |
| ERR2017608_k103_30901_2 | 34.90% | 95.1301 | 3.38E-24 | 68.46% | |
| G48839_k105_52798_10 | 36.80% | 95.1301 | 3.85E-24 | 67.74% | |
| G88935_k105_37556_2 | 36.30% | 94.7449 | 4.40E-24 | 67.38% | |
| G141069_k105_58561_4 | 36.30% | 94.3597 | 5.41E-24 | 67.38% | |
| ERR2017598_k103_20101_4 | 31.30% | 94.3597 | 5.61E-24 | 91.76% | |
| G140062_k105_5474_4 | 32.80% | 94.3597 | 6.94E-24 | 68.82% | |
| G48790_k105_233201_3 | 32.70% | 93.9745 | 7.56E-24 | 72.04% | |
| G48820_k105_6376_48 | 30.50% | 93.5893 | 1.01E-23 | 68.10% | |
| G104929_k105_31220_4 | 33.70% | 93.5893 | 1.04E-23 | 68.82% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017732_k103_18278_4 | 35.80% | 93.9745 | 1.11E−23 | 67.74% | |
| G88903_k105_28222_11 | 31.60% | 93.5893 | 1.11E−23 | 67.74% | |
| CSM79HJS_R_k105_24378_2 | 35.80% | 93.9745 | 1.16E−23 | 67.74% | |
| G140123_k105_19648_3 | 34.40% | 93.2041 | 1.46E−23 | 67.38% | |
| G140170_k105_28494_3 | 35.80% | 93.5893 | 1.48E−23 | 67.74% | |
| ERR2017462_k103_108003_1 | 29.30% | 93.2041 | 1.51E−23 | 70.61% | |
| G139992_k105_29244_74 | 34.20% | 93.2041 | 1.61E−23 | 70.97% | |
| G48790_k105_232273_10 | 35.80% | 92.8189 | 1.64E−23 | 67.38% | |
| ERR2017631_k103_8485_8 | 31.90% | 92.8189 | 1.74E−23 | 91.76% | |
| ERR2017734_k103_25782_5 | 32.50% | 93.2041 | 1.91E−23 | 71.68% | |
| G140763_k105_42939_2 | 32.50% | 92.8189 | 2.03E−23 | 81.00% | |
| G88846_k105_59291_2 | 32.60% | 92.8189 | 2.04E−23 | 75.63% | |
| G48790_k105_15375_2 | 35.60% | 92.8189 | 2.06E−23 | 68.10% | |
| ERR2017526_k103_44983_3 | 29.00% | 92.8189 | 2.20E−23 | 93.19% | |
| G140946_k105_5188_2 | 34.90% | 92.4337 | 2.53E−23 | 67.38% | |
| G140084_k105_29452_1 | 34.40% | 92.4337 | 2.67E−23 | 67.38% | |
| G48806_k105_6571_16 | 29.00% | 92.4337 | 2.91E−23 | 87.46% | |
| ERR2017676_k103_43858_84 | 35.70% | 92.0485 | 3.16E−23 | 69.18% | |
| G48838_k105_70727_1 | 31.30% | 92.4337 | 3.17E−23 | 84.23% | |
| ERR2017707_k103_129_1 | 33.70% | 92.0485 | 3.23E−23 | 68.46% | |
| ERR2017546_k103_45747_2 | 31.40% | 92.0485 | 4.10E−23 | 67.03% | |
| G141019_k105_3266_4 | 29.70% | 92.0485 | 4.10E−23 | 71.33% | |
| G104996_k105_64940_13 | 30.90% | 92.0485 | 4.16E−23 | 68.10% | |
| G104978_k105_15301_14 | 31.60% | 91.6633 | 4.17E−23 | 67.74% | |
| G48819_k105_5295_33 | 28.10% | 91.6633 | 4.35E−23 | 77.42% | |
| G104961_k105_85512_4 | 32.20% | 91.6633 | 4.46E−23 | 71.68% | |
| ERR2017537_k103_30143_5 | 30.50% | 91.6633 | 5.26E−23 | 75.63% | |
| CSM79HI7_R_k105_30053_2 | 30.00% | 91.6633 | 5.97E−23 | 69.53% | |
| G36355_k105_53467_2 | 27.80% | 92.0485 | 6.11E−23 | 96.06% | |
| MSM6J2LL_R_k105_35771_10 | 34.20% | 91.6633 | 6.15E−23 | 68.46% | |
| ERR2017417_k93_30693_2 | 33.30% | 91.2781 | 6.18E−23 | 67.38% | |
| G48841_k105_34004_4 | 33.00% | 91.2781 | 6.35E−23 | 67.03% | |
| G72698_k105_10036_22 | 32.80% | 91.2781 | 6.82E−23 | 67.74% | |
| ERR2017574_k103_25700_5 | 32.20% | 90.8929 | 9.05E−23 | 69.89% | |
| ERR2017560_k103_38773_6 | 35.10% | 90.5077 | 1.07E−22 | 68.10% | |
| G48831_k105_96700_28 | 32.50% | 90.8929 | 1.12E−22 | 68.10% | |
| G140202_k105_73433_3 | 31.00% | 90.5077 | 1.16E−22 | 70.97% | |
| G72726_k105_10981_53 | 28.40% | 90.8929 | 1.16E−22 | 92.11% | |
| G72706_k105_48929_6 | 27.10% | 90.5077 | 1.24E−22 | 74.91% | |
| HSM6XRS6_R_k105_1614_10 | 32.60% | 90.5077 | 1.30E−22 | 67.74% | |
| ERR2017573_k103_64762_4 | 33.70% | 90.1225 | 1.31E−22 | 67.03% | |
| ERR2017729_k103_26930_17 | 33.90% | 90.1225 | 1.46E−22 | 68.10% | |
| G140842_k105_75049_1 | 35.10% | 90.1225 | 1.60E−22 | 66.67% | |
| ERR2017643_k103_82303_1 | 30.40% | 90.1225 | 1.62E−22 | 68.10% | |
| ERR2017520_k103_35629_7 | 30.60% | 89.7373 | 1.63E−22 | 79.93% | |
| ERR2017447_k93_35502_8 | 32.00% | 90.1225 | 1.73E−22 | 68.46% | |
| G48807_k105_45178_5 | 31.80% | 90.1225 | 1.76E−22 | 69.53% | |
| CSM67UAA_R_k105_7607_70 | 34.70% | 90.1225 | 1.78E−22 | 68.46% | |
| G140956_k105_4544_14 | 34.40% | 89.7373 | 1.79E−22 | 67.38% | |
| G48819_k105_16025_5 | 32.10% | 89.7373 | 1.79E−22 | 68.10% | |
| ERR2017685_k103_22047_2 | 30.20% | 90.1225 | 1.84E−22 | 82.80% | |
| G104917_k105_57650_64 | 30.60% | 89.7373 | 2.08E−22 | 68.82% | |
| G48836_k105_6741_54 | 33.00% | 89.7373 | 2.27E−22 | 72.40% | |
| G104981_k105_100786_18 | 30.40% | 89.7373 | 2.32E−22 | 68.10% | |
| G48796_k105_2386_1 | 34.00% | 89.3521 | 2.65E−22 | 66.31% | |
| G48791_k105_15153_2 | 32.30% | 89.3521 | 2.74E−22 | 68.82% | |
| ERR2017571_k103_23286_5 | 30.20% | 89.3521 | 2.95E−22 | 82.80% | |
| G72710_k105_2519_4 | 31.30% | 89.3521 | 3.17E−22 | 69.89% | |
| G48786_k105_293_9 | 33.30% | 89.3521 | 3.31E−22 | 67.03% | |
| ERR2017579_k103_69277_14 | 32.80% | 88.9669 | 3.43E−22 | 68.46% | |
| ERR2017680_k103_24086_4 | 34.60% | 89.3521 | 3.45E−22 | 67.74% | |
| ERR2017637_k103_34182_37 | 34.20% | 89.3521 | 3.49E−22 | 68.46% | |
| HSM7CYX8_R_k105_9231_1 | 30.60% | 88.9669 | 3.49E−22 | 69.89% | |
| ERR2017645_k103_68314_2 | 31.60% | 88.9669 | 3.65E−22 | 71.68% | |
| ERR2017596_k103_3269_7 | 30.10% | 88.9669 | 3.73E−22 | 68.82% | |
| ERR2017631_k103_28158_10 | 31.40% | 88.9669 | 3.78E−22 | 67.03% | |
| ERR2017672_k103_70607_17 | 32.00% | 88.9669 | 3.98E−22 | 72.40% | |
| ERR2017530_k103_89168_1 | 33.90% | 88.9669 | 4.02E−22 | 68.10% | |
| CSM5MCXN_R_k105_40367_5 | 30.60% | 88.9669 | 4.15E−22 | 68.46% | |
| G48806_k105_2407_249 | 33.60% | 88.9669 | 4.26E−22 | 76.70% | |
| G89076_k105_12367_2 | 29.30% | 88.5817 | 4.59E−22 | 70.61% | |
| G48793_k105_55427_2 | 35.60% | 88.9669 | 4.75E−22 | 69.53% | |
| G140202_k105_59108_3 | 34.90% | 88.5817 | 5.16E−22 | 66.67% | |
| ERR2017605_k103_89465_4 | 31.70% | 88.1965 | 5.89E−22 | 67.38% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48789_k105_208170_8 | 30.30% | 88.1965 | 6.42E−22 | 79.93% | |
| G48842_k105_13133_55 | 29.80% | 88.5817 | 6.60E−22 | 76.34% | |
| ERR2017679_k103_31271_57 | 31.10% | 88.5817 | 6.72E−22 | 69.53% | |
| ERR2017554_k103_54487_6 | 31.10% | 88.1965 | 6.74E−22 | 69.89% | |
| CSM5FZ3V_P_R_k105_16476_5 | 30.90% | 88.1965 | 7.24E−22 | 81.00% | |
| ERR2017705_k103_31391_15 | 30.90% | 88.1965 | 7.59E−22 | 67.38% | |
| G72685_k105_24728_3 | 28.90% | 87.8113 | 8.19E−22 | 69.18% | |
| ERR2017630_k103_4998_2 | 31.00% | 87.8113 | 8.48E−22 | 75.99% | |
| G36363_k105_19601_23 | 31.10% | 87.8113 | 8.54E−22 | 68.10% | |
| G48783_k105_20535_1 | 30.70% | 87.8113 | 8.89E−22 | 70.97% | |
| G104903_k105_38894_2 | 29.80% | 87.8113 | 9.32E−22 | 68.10% | |
| ERR2017604_k103_15448_7 | 33.30% | 87.8113 | 9.72E−22 | 68.10% | |
| G139962_k105_9708_29 | 31.10% | 87.8113 | 1.02E−21 | 67.38% | |
| CSM79HHM_R_k105_56064_17 | 30.40% | 87.8113 | 1.03E−21 | 68.10% | |
| G48840_k105_27043_12 | 29.30% | 87.8113 | 1.11E−21 | 68.10% | |
| G141082_k105_46179_2 | 32.70% | 87.4261 | 1.12E−21 | 61.29% | |
| G72705_k105_88413_9 | 32.30% | 87.8113 | 1.12E−21 | 92.83% | |
| PSM7J19Z_R_k105_8383_1 | 29.30% | 87.8113 | 1.15E−21 | 79.93% | |
| ERR2017577_k103_34879_2 | 32.30% | 87.8113 | 1.16E−21 | 69.18% | |
| ERR2017715_k103_13231_3 | 31.50% | 87.4261 | 1.17E−21 | 78.49% | |
| ERR2017531_k103_7041_2 | 30.70% | 87.4261 | 1.19E−21 | 70.97% | |
| ERR2017726_k103_56_15 | 31.10% | 87.4261 | 1.20E−21 | 78.49% | |
| G105053_k105_36503_23 | 31.80% | 87.4261 | 1.26E−21 | 68.46% | |
| G140911_k105_70382_53 | 31.10% | 87.8113 | 1.26E−21 | 67.74% | |
| G36362_k105_86628_2 | 30.60% | 87.8113 | 1.26E−21 | 68.82% | |
| G104891_k105_9620_15 | 31.40% | 87.8113 | 1.34E−21 | 73.84% | |
| G89268_k105_5906_8 | 30.10% | 87.8113 | 1.38E−21 | 73.84% | |
| G140016_k105_3400_2 | 32.80% | 87.4261 | 1.39E−21 | 68.10% | |
| ERR2017639_k103_30779_2 | 31.20% | 87.4261 | 1.45E−21 | 70.25% | |
| MSM79HBR_R_k105_14580_1 | 31.20% | 87.4261 | 1.46E−21 | 67.38% | |
| ERR2017659_k103_123660_3 | 32.50% | 87.4261 | 1.52E−21 | 69.18% | |
| ERR2017631_k103_75292_2 | 30.60% | 87.0409 | 1.63E−21 | 78.49% | |
| G140117_k105_31657_47 | 30.70% | 87.0409 | 1.65E−21 | 69.53% | |
| G48790_k105_240741_28 | 28.90% | 87.0409 | 1.71E−21 | 67.74% | |
| MSM79HDE_R_k105_18251_9 | 36.00% | 87.0409 | 1.74E−21 | 70.97% | |
| CSM79H0Z_R_k105_13353_3 | 34.60% | 87.0409 | 1.74E−21 | 66.67% | |
| ERR2017604_k103_9572_2 | 31.10% | 87.0409 | 1.79E−21 | 67.38% | |
| G140766_k105_89589_11 | 30.90% | 87.0409 | 1.83E−21 | 79.57% | |
| HSMA33IA_R_k105_28475_2 | 29.20% | 87.0409 | 1.86E−21 | 68.46% | |
| ERR2017639_k103_25741_2 | 31.10% | 87.0409 | 1.92E−21 | 78.49% | |
| ERR2017478_k79_92921_5 | 28.90% | 87.0409 | 1.93E−21 | 67.74% | |
| G140002_k105_35037_2 | 30.70% | 87.0409 | 1.97E−21 | 71.68% | |
| CSM79HNW_R_k105_1180_6 | 25.90% | 87.0409 | 1.97E−21 | 82.44% | |
| MSM79HBR_R_k105_7392_191 | 31.90% | 87.0409 | 2.07E−21 | 67.74% | |
| ERR2017468_k103_8422_46 | 29.80% | 86.6557 | 2.15E−21 | 68.10% | |
| ERR2017614_k103_90584_2 | 32.30% | 86.6557 | 2.23E−21 | 70.97% | |
| ERR2017688_k103_79028_12 | 31.80% | 86.6557 | 2.28E−21 | 69.53% | |
| ERR2017700_k103_20170_20 | 31.40% | 86.6557 | 2.33E−21 | 68.10% | |
| ERR2017589_k103_50590_2 | 30.60% | 86.6557 | 2.49E−21 | 69.53% | |
| ERR2017466_k103_10370_2 | 34.20% | 86.6557 | 2.51E−21 | 68.10% | |
| G48841_k105_20232_2 | 33.50% | 86.2705 | 2.66E−21 | 68.46% | |
| ERR2017512_k79_51552_17 | 30.50% | 86.6557 | 2.66E−21 | 67.38% | |
| ERR2017460_k93_53799_72 | 30.60% | 86.6557 | 2.68E−21 | 68.82% | |
| HSMA33KS_R_k105_9141_3 | 32.80% | 86.6557 | 2.75E−21 | 68.10% | |
| G140023_k105_7679_2 | 33.70% | 86.2705 | 2.80E−21 | 68.10% | |
| ERR2017639_k103_21150_3 | 32.20% | 86.2705 | 2.98E−21 | 70.25% | |
| G140963_k105_7582_3 | 29.50% | 86.2705 | 3.03E−21 | 67.74% | |
| ERR2017579_k103_130085_3 | 31.30% | 86.2705 | 3.14E−21 | 68.10% | |
| G48819_k105_8761_25 | 30.80% | 86.2705 | 3.17E−21 | 61.65% | |
| ERR2017667_k103_22283_2 | 32.00% | 85.8853 | 3.24E−21 | 69.18% | |
| PSM7J1A2_R_k105_41830_4 | 28.10% | 86.2705 | 3.27E−21 | 68.10% | |
| ERR2017698_k103_86960_2 | 30.80% | 85.8853 | 3.29E−21 | 82.44% | |
| ERR2017621_k103_13678_2 | 30.00% | 86.2705 | 3.33E−21 | 78.49% | |
| ERR2017636_k103_1676_2 | 31.10% | 86.2705 | 3.36E−21 | 67.38% | |
| G105117_k105_98511_3 | 30.50% | 86.2705 | 3.45E−21 | 70.61% | |
| G48790_k105_260684_12 | 34.00% | 86.2705 | 3.76E−21 | 68.46% | |
| ERR2017649_k103_96852_2 | 31.70% | 85.8853 | 3.82E−21 | 67.38% | |
| ERR2017529_k103_44554_37 | 30.70% | 87.0409 | 3.82E−21 | 75.63% | |
| MSM79H7Q_R_k105_52885_2 | 31.60% | 85.8853 | 3.90E−21 | 69.53% | |
| ERR2017519_k103_59931_10 | 30.30% | 85.8853 | 4.01E−21 | 69.53% | |
| MSM79HBR_R_k105_20818_96 | 31.60% | 85.8853 | 4.09E−21 | 67.38% | |
| G140786_k105_12264_2 | 30.50% | 85.8853 | 4.09E−21 | 67.38% | |
| G72673_k105_23034_1 | 25.90% | 85.8853 | 4.29E−21 | 82.44% | |
| G140760_k105_25722_5 | 25.70% | 85.8853 | 4.57E−21 | 74.91% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G140113_k105_46706_43 | 30.40% | 85.8853 | 4.58E-21 | 68.10% | |
| HSM5MD6Q_R_k105_1102_42 | 30.20% | 85.8853 | 4.71E-21 | 71.33% | |
| ERR2017637_k103_19638_30 | 32.80% | 85.8853 | 4.84E-21 | 69.53% | |
| ERR2017570_k103_37316_156 | 30.70% | 85.5001 | 4.88E-21 | 70.97% | |
| PSM7J14X_R_k105_38756_3 | 29.30% | 85.8853 | 4.89E-21 | 67.03% | |
| ERR2017562_k103_235_1 | 28.20% | 85.8853 | 4.89E-21 | 71.33% | |
| ERR2017546_k103_13609_34 | 31.00% | 85.5001 | 4.96E-21 | 66.67% | |
| ERR2017643_k103_31501_2 | 31.60% | 85.8853 | 5.07E-21 | 78.14% | |
| ERR2017707_k103_42217_5 | 30.50% | 85.5001 | 5.07E-21 | 67.38% | |
| G141049_k105_41538_4 | 29.00% | 85.5001 | 5.07E-21 | 68.46% | |
| ERR2017614_k103_87945_15 | 30.80% | 85.5001 | 5.31E-21 | 69.53% | |
| ERR2017541_k103_42614_1 | 29.60% | 85.8853 | 5.41E-21 | 72.40% | |
| G72705_k105_28979_30 | 30.10% | 85.5001 | 5.47E-21 | 69.89% | |
| G140962_k105_35121_2 | 30.30% | 85.5001 | 5.57E-21 | 77.06% | |
| G88691_k105_48085_2 | 29.50% | 85.5001 | 5.57E-21 | 79.93% | |
| ERR2017678_k103_8421_1 | 29.60% | 85.5001 | 5.95E-21 | 70.97% | |
| G36387_k105_944_1 | 31.80% | 85.5001 | 5.98E-21 | 69.53% | |
| ERR2017686_k103_86463_6 | 31.40% | 85.5001 | 6.01E-21 | 70.97% | |
| ERR2017676_k103_73473_3 | 30.20% | 85.5001 | 6.06E-21 | 67.38% | |
| ERR2017541_k103_36965_3 | 32.30% | 85.5001 | 6.09E-21 | 66.31% | |
| G88922_k105_5121_33 | 29.00% | 85.5001 | 6.15E-21 | 68.82% | |
| G48807_k105_51508_2 | 29.70% | 85.5001 | 6.41E-21 | 78.49% | |
| G72690_k105_11219_11 | 31.40% | 85.5001 | 6.47E-21 | 68.46% | |
| G88870_k105_83264_2 | 30.70% | 85.5001 | 6.65E-21 | 68.46% | |
| ERR2017434_k93_59901_7 | 32.80% | 85.1149 | 6.77E-21 | 68.10% | |
| ERR2017560_k103_25520_13 | 30.50% | 85.1149 | 6.89E-21 | 66.67% | |
| MSM9VZIY_R_k105_14291_5 | 28.70% | 85.1149 | 7.17E-21 | 71.33% | |
| ERR2017590_k103_10699_4 | 31.20% | 85.5001 | 7.18E-21 | 79.93% | |
| G140017_k105_53136_4 | 31.60% | 85.1149 | 7.38E-21 | 67.38% | |
| ERR2017615_k103_17583_4 | 29.70% | 85.1149 | 7.45E-21 | 78.49% | |
| ESM5MEE6_P_R_k105_12293_2 | 32.90% | 85.1149 | 7.51E-21 | 60.93% | |
| G140956_k105_75731_4 | 32.40% | 85.1149 | 8.15E-21 | 67.03% | |
| ERR2017715_k103_86158_4 | 28.60% | 85.1149 | 8.18E-21 | 78.49% | |
| CSM5MCZD_R_k105_43999_2 | 30.50% | 85.1149 | 8.32E-21 | 70.61% | |
| HSM6XRS6_R_k105_2394_2 | 29.80% | 85.1149 | 8.33E-21 | 68.10% | |
| G141100_k105_10713_3 | 29.80% | 85.1149 | 8.48E-21 | 69.89% | |
| G139991_k105_2956_3 | 30.20% | 85.1149 | 8.49E-21 | 71.33% | |
| ERR2017543_k103_47767_4 | 29.10% | 85.1149 | 8.89E-21 | 69.53% | |
| ERR2017519_k103_10728_7 | 31.10% | 84.7297 | 9.32E-21 | 67.38% | |
| G48836_k105_2452_2 | 29.90% | 84.7297 | 9.49E-21 | 68.82% | |
| G36392_k105_54916_3 | 28.00% | 84.7297 | 9.59E-21 | 68.82% | |
| G140984_k105_43097_4 | 27.80% | 84.7297 | 9.68E-21 | 72.40% | |
| ERR2017466_k103_51357_2 | 32.40% | 84.7297 | 9.86E-21 | 67.03% | |
| ERR2017736_k103_29211_2 | 30.20% | 84.7297 | 1.01E-20 | 78.49% | |
| PSM7J14L_R_k105_788_2 | 30.80% | 84.7297 | 1.03E-20 | 92.83% | |
| MSM79H94_P_R_k105_2831_50 | 29.30% | 84.7297 | 1.03E-20 | 68.10% | |
| G48819_k105_16762_2 | 29.70% | 84.7297 | 1.07E-20 | 61.65% | |
| ERR2017682_k103_7936_49 | 32.10% | 84.7297 | 1.08E-20 | 68.46% | |
| G48832_k105_52527_47 | 30.50% | 84.7297 | 1.13E-20 | 68.82% | |
| G140194_k105_52711_1 | 31.30% | 84.7297 | 1.22E-20 | 68.10% | |
| ERR2017579_k103_16935_19 | 32.30% | 84.3445 | 1.24E-20 | 68.10% | |
| ERR2017653_k103_21549_2 | 31.20% | 84.7297 | 1.25E-20 | 70.25% | |
| G141007_k105_20199_3 | 32.50% | 84.7297 | 1.27E-20 | 71.33% | |
| G104942_k105_86095_1 | 30.30% | 84.7297 | 1.29E-20 | 69.53% | |
| ERR2017545_k103_30362_5 | 34.40% | 84.3445 | 1.30E-20 | 68.10% | |
| G139991_k105_59268_1 | 30.40% | 84.3445 | 1.33E-20 | 68.10% | |
| HSM7CYYB_R_k105_1319_54 | 30.50% | 84.3445 | 1.36E-20 | 68.10% | |
| G72697_k105_41131_2 | 28.80% | 84.3445 | 1.45E-20 | 72.40% | |
| G36361_k105_31302_2 | 29.70% | 84.3445 | 1.48E-20 | 78.49% | |
| PSMA2668_R_k105_22069_5 | 30.50% | 84.3445 | 1.50E-20 | 67.38% | |
| G48807_k105_71348_2 | 29.60% | 84.3445 | 1.50E-20 | 67.38% | |
| G105029_k105_62044_2 | 30.20% | 84.3445 | 1.58E-20 | 68.46% | |
| G48791_k105_153014_9 | 30.70% | 84.7297 | 1.59E-20 | 75.63% | |
| ERR2017682_k103_21803_1 | 31.20% | 83.9593 | 1.73E-20 | 70.97% | |
| G140796_k105_16048_2 | 29.40% | 83.9593 | 1.73E-20 | 67.74% | |
| G140829_k105_29833_4 | 31.40% | 83.9593 | 1.79E-20 | 74.91% | |
| G48840_k105_54880_2 | 30.20% | 83.9593 | 1.80E-20 | 78.49% | |
| G140884_k105_38182_27 | 29.80% | 83.9593 | 1.85E-20 | 68.10% | |
| G48821_k105_25306_6 | 33.90% | 83.9593 | 1.92E-20 | 67.74% | |
| PSMA2668_R_k105_15422_6 | 30.10% | 83.9593 | 1.99E-20 | 68.46% | |
| ERR2017650_k103_32187_1 | 29.10% | 83.9593 | 2.01E-20 | 67.38% | |
| G88693_k105_33027_5 | 34.30% | 83.9593 | 2.02E-20 | 68.82% | |
| ERR2017719_k103_84431_2 | 34.30% | 83.9593 | 2.03E-20 | 68.82% | |
| ERR2017643_k103_56845_13 | 29.60% | 83.9593 | 2.03E-20 | 66.31% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017656_k103_73644_2 | 29.60% | 83.9593 | 2.06E-20 | 67.38% | |
| ERR2017700_k103_958_15 | 28.10% | 84.3445 | 2.08E-20 | 69.53% | |
| G141818_k105_41977_5 | 29.30% | 83.5741 | 2.43E-20 | 74.19% | |
| ERR2017519_k103_30088_1 | 33.00% | 83.5741 | 2.44E-20 | 68.10% | |
| ERR2017546_k103_19428_5 | 34.30% | 83.5741 | 2.45E-20 | 68.82% | |
| G48791_k105_86514_14 | 29.50% | 83.5741 | 2.45E-20 | 67.38% | |
| CSM79HRC_R_k105_17222_4 | 33.00% | 83.5741 | 2.49E-20 | 68.46% | |
| G48836_k105_1332_16 | 26.10% | 83.5741 | 2.69E-20 | 81.36% | |
| MSM6J2LW_R_k105_6849_1 | 27.70% | 83.5741 | 2.72E-20 | 68.10% | |
| ERR2017711_k103_60104_4 | 28.50% | 83.1889 | 2.98E-20 | 73.84% | |
| CSMACTZP_R_k105_7189_1 | 33.80% | 83.1889 | 3.06E-20 | 71.33% | |
| G104939_k105_14838_1 | 31.90% | 83.5741 | 3.10E-20 | 66.31% | |
| ERR2017613_k103_17263_21 | 31.30% | 83.1889 | 3.13E-20 | 67.74% | |
| ERR2017449_k93_58342_6 | 33.90% | 83.1889 | 3.42E-20 | 67.38% | |
| G48819_k105_3951_2 | 29.10% | 83.1889 | 3.43E-20 | 67.38% | |
| G72676_k105_8404_3 | 29.20% | 83.1889 | 3.67E-20 | 69.53% | |
| HSM7J4NU_R_k105_60563_136 | 28.20% | 83.1889 | 3.77E-20 | 72.40% | |
| G48792_k105_47770_55 | 33.90% | 83.1889 | 3.84E-20 | 66.31% | |
| G140194_k105_2179_5 | 28.60% | 83.1889 | 3.84E-20 | 79.57% | |
| G88828_k105_42831_2 | 28.30% | 83.1889 | 3.88E-20 | 72.40% | |
| ERR2017676_k103_30005_3 | 31.20% | 83.1889 | 3.99E-20 | 70.25% | |
| G140114_k105_36158_1 | 30.60% | 82.8037 | 4.00E-20 | 62.01% | |
| ERR2017658_k103_54515_4 | 34.60% | 82.8037 | 4.02E-20 | 68.82% | |
| G48814_k105_38343_143 | 30.20% | 82.8037 | 4.02E-20 | 70.97% | |
| G48817_k105_74075_5 | 30.90% | 82.8037 | 4.06E-20 | 68.10% | |
| ERR2017569_k103_32123_1 | 29.60% | 82.8037 | 4.13E-20 | 81.72% | |
| G140785_k105_75533_3 | 30.50% | 82.8037 | 4.14E-20 | 71.33% | |
| G139992_k105_8489_19 | 30.40% | 83.1889 | 4.14E-20 | 68.10% | |
| ERR2017542_k103_24755_5 | 29.70% | 83.1889 | 4.14E-20 | 84.59% | |
| ERR2017634_k103_18448_9 | 29.70% | 82.8037 | 4.21E-20 | 74.91% | |
| G140004_k105_42470_1 | 27.40% | 82.8037 | 4.30E-20 | 82.08% | |
| G140037_k105_35216_1 | 34.00% | 82.8037 | 4.34E-20 | 67.03% | |
| G48806_k105_17989_2 | 24.60% | 82.8037 | 4.42E-20 | 84.59% | |
| ERR2017631_k103_9179_2 | 28.10% | 82.8037 | 4.51E-20 | 88.89% | |
| MSM9VZMC_R_k105_1759_2 | 30.70% | 82.8037 | 4.55E-20 | 69.18% | |
| ERR2017598_k103_14921_3 | 29.20% | 82.8037 | 4.55E-20 | 69.53% | |
| G72720_k105_35517_1 | 30.20% | 83.1889 | 4.58E-20 | 67.74% | |
| G48817_k105_101466_2 | 30.20% | 82.8037 | 4.72E-20 | 72.04% | |
| G140170_k105_34453_1 | 34.40% | 82.8037 | 4.76E-20 | 68.10% | |
| G104923_k105_5159_1 | 31.10% | 82.8037 | 4.82E-20 | 74.91% | |
| G48817_k105_153705_4 | 31.10% | 82.8037 | 4.86E-20 | 59.50% | |
| ERR2017600_k103_37265_2 | 34.60% | 82.8037 | 4.99E-20 | 68.82% | |
| G72718_k105_111961_2 | 30.40% | 82.8037 | 5.19E-20 | 68.10% | |
| G48789_k105_149270_9 | 31.90% | 82.4185 | 5.21E-20 | 74.91% | |
| ERR2017645_k103_31037_6 | 31.30% | 82.8037 | 5.24E-20 | 68.10% | |
| CSM5MCWG_R_k105_9232_23 | 29.10% | 82.8037 | 5.39E-20 | 74.55% | |
| G36361_k105_23481_2 | 31.80% | 82.8037 | 5.74E-20 | 68.10% | |
| G140880_k105_29002_6 | 30.00% | 82.4185 | 5.81E-20 | 67.38% | |
| G140856_k105_85477_17 | 27.80% | 83.1889 | 5.85E-20 | 72.40% | |
| MSM9VZHB_R_k105_7308_3 | 33.70% | 82.8037 | 5.87E-20 | 69.53% | |
| ERR2017645_k103_53452_2 | 31.30% | 82.4185 | 5.87E-20 | 70.97% | |
| ERR2017674_k103_17580_2 | 30.20% | 82.4185 | 5.92E-20 | 78.49% | |
| G88922_k105_28537_7 | 30.70% | 82.8037 | 6.09E-20 | 69.18% | |
| G89268_k105_89716_3 | 29.30% | 82.4185 | 6.09E-20 | 68.10% | |
| G48790_k105_116212_2 | 32.50% | 82.4185 | 6.14E-20 | 68.10% | |
| G48817_k105_201956_3 | 30.90% | 82.4185 | 6.20E-20 | 68.10% | |
| MSM5LLE3_P_R_k105_19190_12 | 31.30% | 82.4185 | 6.56E-20 | 73.84% | |
| ERR2017462_k103_105205_9 | 29.90% | 82.4185 | 6.69E-20 | 70.25% | |
| G140004_k105_60738_19 | 34.70% | 82.0333 | 6.78E-20 | 60.93% | |
| G36370_k105_6051_96 | 31.50% | 82.4185 | 7.14E-20 | 69.89% | |
| G48820_k105_10194_30 | 29.30% | 82.4185 | 7.22E-20 | 67.74% | |
| ERR2017592_k103_6902_21 | 32.10% | 82.0333 | 7.24E-20 | 66.31% | |
| ERR2017645_k103_50783_2 | 31.40% | 82.0333 | 7.47E-20 | 67.38% | |
| G72724_k105_78628_64 | 31.40% | 82.4185 | 7.63E-20 | 67.74% | |
| G48821_k105_905_64 | 28.90% | 82.0333 | 7.64E-20 | 67.74% | |
| ERR2017621_k103_14029_2 | 30.20% | 82.0333 | 8.01E-20 | 68.10% | |
| PSM7J1BP_R_k105_4738_2 | 32.60% | 82.0333 | 8.06E-20 | 67.74% | |
| ERR2017596_k103_13147_6 | 29.20% | 82.0333 | 8.09E-20 | 69.53% | |
| ERR2017713_k103_83105_6 | 31.30% | 82.0333 | 8.15E-20 | 68.46% | |
| MSM5LLE3_P_R_k105_35173_16 | 28.90% | 82.0333 | 8.15E-20 | 70.61% | |
| ERR2017632_k103_97161_4 | 29.50% | 82.0333 | 8.43E-20 | 68.10% | |
| G140099_k105_23605_3 | 30.50% | 82.0333 | 9.14E-20 | 66.31% | |
| ERR2017638_k103_87961_2 | 30.20% | 82.0333 | 9.14E-20 | 68.10% | |
| G140040_k105_32777_2 | 31.00% | 82.0333 | 9.20E-20 | 69.18% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G72708_k105_31001_38 | 32.70% | 82.0333 | 9.32E−20 | 68.10% | |
| ERR2017533_k103_82027_2 | 32.20% | 82.0333 | 9.57E−20 | 68.46% | |
| G88903_k105_20096_2 | 31.20% | 82.0333 | 9.57E−20 | 67.38% | |
| G140157_k105_13446_55 | 30.30% | 82.4185 | 9.92E−20 | 69.53% | |
| G48791_k105_146334_1 | 30.20% | 82.0333 | 1.00E−19 | 71.68% | |
| G48815_k105_21006_2 | 28.70% | 82.0333 | 1.00E−19 | 69.53% | |
| ERR2017673_k103_108417_7 | 25.90% | 82.0333 | 1.00E−19 | 93.55% | |
| ERR2017616_k103_92453_2 | 32.50% | 81.6481 | 1.01E−19 | 68.10% | |
| G88780_k105_47792_2 | 30.30% | 81.6481 | 1.07E−19 | 69.89% | |
| G48793_k105_101096_2 | 30.20% | 81.6481 | 1.07E−19 | 70.97% | |
| G48807_k105_120238_6 | 32.10% | 81.6481 | 1.08E−19 | 67.38% | |
| G88990_k105_18624_3 | 32.30% | 81.6481 | 1.09E−19 | 69.89% | |
| ERR2017631_k103_35716_2 | 28.30% | 81.6481 | 1.10E−19 | 72.76% | |
| G88847_k105_45228_2 | 31.80% | 81.6481 | 1.11E−19 | 68.46% | |
| ERR2017637_k103_71747_3 | 30.70% | 81.6481 | 1.15E−19 | 69.53% | |
| ERR2017674_k103_2001_1 | 30.80% | 81.6481 | 1.16E−19 | 68.82% | |
| G72704_k105_26791_2 | 29.70% | 81.6481 | 1.16E−19 | 78.49% | |
| G72676_k105_40564_3 | 30.80% | 81.6481 | 1.17E−19 | 70.97% | |
| ERR2017647_k103_66279_2 | 30.30% | 81.6481 | 1.21E−19 | 67.38% | |
| G72724_k105_56209_57 | 31.70% | 81.6481 | 1.28E−19 | 67.38% | |
| ERR2017728_k103_26137_2 | 30.40% | 81.6481 | 1.28E−19 | 72.76% | |
| G141001_k105_1032_16 | 30.00% | 81.6481 | 1.28E−19 | 67.38% | |
| ERR2017647_k103_35937_27 | 29.20% | 81.6481 | 1.33E−19 | 68.10% | |
| G72674_k105_50410_2 | 34.70% | 81.2629 | 1.36E−19 | 68.10% | |
| ERR2017522_k103_75403_15 | 29.70% | 81.2629 | 1.41E−19 | 68.46% | |
| G141818_k105_36847_3 | 29.20% | 81.6481 | 1.41E−19 | 69.53% | |
| G48832_k105_61986_2 | 28.70% | 81.6481 | 1.43E−19 | 69.53% | |
| ERR2017576_k103_55329_31 | 29.70% | 81.2629 | 1.44E−19 | 67.74% | |
| ERR2017667_k103_23517_2 | 29.40% | 81.2629 | 1.45E−19 | 69.53% | |
| HSM5MD8J_P_R_k105_28407_2 | 27.30% | 81.6481 | 1.45E−19 | 72.04% | |
| ERR2017540_k103_49610_4 | 31.10% | 81.2629 | 1.49E−19 | 78.85% | |
| ERR2017675_k103_89501_3 | 29.20% | 81.2629 | 1.49E−19 | 69.53% | |
| ESM5MEB7_R_k105_43306_5 | 29.80% | 81.2629 | 1.51E−19 | 67.03% | |
| G105030_k105_45566_1 | 32.50% | 81.2629 | 1.55E−19 | 68.10% | |
| ERR2017570_k103_24913_14 | 29.60% | 81.2629 | 1.55E−19 | 67.38% | |
| ERR2017627_k103_1345_17 | 29.10% | 81.2629 | 1.55E−19 | 67.38% | |
| G88935_k105_45458_3 | 31.60% | 81.2629 | 1.56E−19 | 67.03% | |
| ERR2017617_k103_19201_14 | 32.60% | 81.2629 | 1.61E−19 | 67.74% | |
| G104932_k105_34100_1 | 30.70% | 81.2629 | 1.69E−19 | 72.40% | |
| MSM5LLEP_R_k105_14521_2 | 30.40% | 81.2629 | 1.72E−19 | 68.46% | |
| ERR2017593_k103_58240_8 | 29.90% | 81.2629 | 1.78E−19 | 68.82% | |
| ERR2017636_k103_10144_7 | 32.80% | 81.2629 | 1.87E−19 | 67.74% | |
| ERR2017615_k103_32102_3 | 29.60% | 80.8777 | 2.04E−19 | 67.38% | |
| ERR2017637_k103_58392_1 | 34.40% | 80.8777 | 2.07E−19 | 68.10% | |
| G36359_k105_30659_14 | 30.20% | 80.8777 | 2.10E−19 | 69.53% | |
| HSM7J4MY_R_k105_26504_2 | 30.60% | 81.2629 | 2.11E−19 | 66.31% | |
| G88798_k105_24965_1 | 29.10% | 80.8777 | 2.15E−19 | 67.38% | |
| ERR2017579_k103_120694_3 | 30.20% | 80.8777 | 2.24E−19 | 78.49% | |
| ERR2017717_k103_52830_2 | 27.70% | 80.8777 | 2.25E−19 | 72.40% | |
| MSM79HC8_R_k105_52475_11 | 29.70% | 80.8777 | 2.28E−19 | 68.46% | |
| HSM67VFX_P_R_k105_36206_2 | 26.60% | 80.8777 | 2.29E−19 | 81.00% | |
| G48817_k105_10718_12 | 27.90% | 80.8777 | 2.38E−19 | 89.25% | |
| G140799_k105_74553_5 | 27.50% | 81.2629 | 2.41E−19 | 68.82% | |
| ERR2017499_k103_44348_5 | 31.30% | 80.8777 | 2.47E−19 | 68.10% | |
| ERR2017726_k103_17011_38 | 29.10% | 80.8777 | 2.51E−19 | 71.68% | |
| ERR2017529_k103_16686_2 | 32.00% | 80.4925 | 2.58E−19 | 68.82% | |
| CSM5MCYS_R_k105_6727_3 | 30.20% | 80.8777 | 2.61E−19 | 68.46% | |
| G48836_k105_4249_254 | 29.00% | 80.8777 | 2.67E−19 | 71.33% | |
| G140108_k105_20181_6 | 30.60% | 80.4925 | 2.68E−19 | 67.38% | |
| ERR2017604_k103_65881_13 | 33.20% | 80.4925 | 2.72E−19 | 68.10% | |
| G141092_k105_10981_4 | 31.30% | 80.4925 | 2.74E−19 | 68.46% | |
| G72697_k105_57353_25 | 31.20% | 80.4925 | 2.77E−19 | 60.93% | |
| G88761_k105_26629_15 | 29.10% | 80.4925 | 2.84E−19 | 67.38% | |
| G48789_k105_111433_27 | 31.20% | 80.4925 | 3.00E−19 | 69.89% | |
| G105082_k105_52529_2 | 33.90% | 80.4925 | 3.01E−19 | 68.46% | |
| ERR2017447_k93_44449_16 | 29.20% | 80.4925 | 3.05E−19 | 68.10% | |
| G48819_k105_15227_376 | 26.00% | 80.1073 | 3.22E−19 | 75.63% | |
| ERR2017639_k103_11789_18 | 30.90% | 80.4925 | 3.41E−19 | 68.10% | |
| ERR2017464_k103_2636_3 | 27.80% | 80.4925 | 3.41E−19 | 72.40% | |
| ERR2017700_k103_67776_4 | 29.20% | 80.4925 | 3.51E−19 | 69.53% | |
| G88861_k105_1699_3 | 30.10% | 80.4925 | 3.53E−19 | 69.53% | |
| G48786_k105_9077_12 | 32.30% | 80.1073 | 3.59E−19 | 68.46% | |
| G140922_k105_25190_14 | 30.40% | 80.4925 | 3.59E−19 | 68.10% | |
| G104932_k105_62636_3 | 31.40% | 80.1073 | 3.63E−19 | 68.10% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017534_k103_93173_1 | 31.40% | 80.1073 | 3.65E-19 | 67.03% | |
| G48832_k105_113_4 | 30.20% | 80.1073 | 3.68E-19 | 70.97% | |
| G48822_k105_4160_2 | 30.50% | 80.1073 | 3.70E-19 | 68.82% | |
| G36361_k105_7437_2 | 29.70% | 80.1073 | 3.85E-19 | 78.49% | |
| G36396_k105_1379_3 | 29.70% | 80.1073 | 3.88E-19 | 81.36% | |
| G104948_k105_50358_2 | 30.20% | 80.1073 | 3.89E-19 | 68.10% | |
| G141820_k105_8524_11 | 31.00% | 80.4925 | 3.96E-19 | 68.46% | |
| G72690_k105_32079_52 | 30.80% | 80.1073 | 3.99E-19 | 68.10% | |
| G104824_k105_39681_1 | 29.90% | 80.1073 | 4.01E-19 | 82.80% | |
| G141077_k105_7789_2 | 32.10% | 79.7221 | 4.38E-19 | 66.67% | |
| ERR2017546_k103_48458_17 | 30.50% | 80.8777 | 4.45E-19 | 70.97% | |
| G35127_k105_1676_52 | 29.30% | 80.1073 | 4.58E-19 | 69.89% | |
| G140880_k105_13384_3 | 31.90% | 79.7221 | 4.64E-19 | 68.10% | |
| ERR2017705_k103_118784_17 | 30.10% | 79.7221 | 4.65E-19 | 68.46% | |
| G48820_k105_10194_88 | 30.70% | 80.1073 | 4.72E-19 | 71.68% | |
| G139998_k105_43619_2 | 29.30% | 79.7221 | 4.76E-19 | 75.63% | |
| G48823_k105_79555_27 | 31.60% | 80.1073 | 4.78E-19 | 67.74% | |
| G104951_k105_10284_2 | 28.50% | 80.1073 | 4.78E-19 | 88.17% | |
| G72711_k105_8997_61 | 31.20% | 80.1073 | 4.92E-19 | 69.53% | |
| G104827_k105_55720_3 | 28.30% | 79.7221 | 5.00E-19 | 68.10% | |
| MSM79HBR_R_k105_15956_1 | 31.90% | 79.7221 | 5.05E-19 | 68.10% | |
| G88909_k105_18215_34 | 31.60% | 79.7221 | 5.16E-19 | 67.74% | |
| G104871_k105_29408_2 | 30.20% | 80.1073 | 5.17E-19 | 67.74% | |
| G104973_k105_42961_8 | 29.20% | 79.7221 | 5.29E-19 | 69.53% | |
| ERR2017615_k103_36116_37 | 32.50% | 79.7221 | 5.56E-19 | 68.10% | |
| G48780_k105_3277_39 | 35.50% | 79.7221 | 5.58E-19 | 61.29% | |
| G104934_k105_72385_2 | 30.70% | 79.7221 | 5.68E-19 | 68.46% | |
| G48784_k105_81628_2 | 29.70% | 80.1073 | 5.70E-19 | 74.19% | |
| ERR2017562_k103_55879_3 | 32.50% | 79.337 | 5.99E-19 | 68.10% | |
| ERR2017521_k103_95312_16 | 31.30% | 79.7221 | 5.99E-19 | 68.46% | |
| ERR2017579_k103_39438_3 | 29.30% | 79.7221 | 6.15E-19 | 68.10% | |
| G48806_k105_19999_2 | 29.90% | 79.337 | 6.26E-19 | 69.18% | |
| G104846_k105_38173_5 | 32.10% | 79.7221 | 6.33E-19 | 68.46% | |
| G36350_k105_31333_4 | 27.50% | 79.337 | 6.36E-19 | 67.38% | |
| ERR2017618_k103_58465_2 | 36.20% | 79.7221 | 6.66E-19 | 68.82% | |
| G36380_k105_43646_24 | 30.90% | 79.337 | 6.83E-19 | 68.10% | |
| HSM5MD7Q_R_k105_12755_5 | 32.30% | 79.337 | 6.92E-19 | 68.10% | |
| ERR2017650_k103_100733_2 | 33.50% | 79.337 | 7.61E-19 | 68.10% | |
| ERR2017543_k103_52586_15 | 30.60% | 79.337 | 7.66E-19 | 67.74% | |
| G141011_k105_85952_7 | 32.40% | 79.337 | 7.70E-19 | 70.97% | |
| ERR2017459_k93_24389_1 | 25.90% | 79.337 | 7.71E-19 | 82.44% | |
| ERR2017639_k103_46545_4 | 28.70% | 79.337 | 7.83E-19 | 69.53% | |
| G36375_k105_17903_5 | 29.80% | 79.337 | 7.85E-19 | 68.82% | |
| ERR2017461_k103_26273_2 | 31.20% | 79.337 | 7.88E-19 | 69.53% | |
| ERR2017729_k103_71253_23 | 30.70% | 78.9518 | 7.91E-19 | 67.03% | |
| G48780_k105_105879_11 | 32.30% | 79.337 | 8.17E-19 | 67.38% | |
| ERR2017487_k79_31161_2 | 32.30% | 79.337 | 8.29E-19 | 68.46% | |
| ERR2017611_k103_15650_15 | 30.90% | 78.9518 | 8.31E-19 | 68.46% | |
| ERR2017602_k103_53264_2 | 29.60% | 78.9518 | 8.44E-19 | 67.38% | |
| G89058_k105_67579_2 | 31.40% | 78.9518 | 8.45E-19 | 68.10% | |
| G48798_k105_91248_2 | 30.20% | 79.337 | 8.61E-19 | 74.91% | |
| ERR2017569_k103_106426_68 | 32.40% | 78.9518 | 8.78E-19 | 66.67% | |
| ERR2017570_k103_9731_2 | 31.90% | 78.9518 | 8.78E-19 | 68.10% | |
| G105053_k105_605_1 | 30.70% | 78.9518 | 8.94E-19 | 74.91% | |
| G88887_k105_2260_4 | 28.30% | 79.337 | 8.97E-19 | 72.40% | |
| ERR2017623_k103_15392_9 | 30.90% | 79.337 | 9.08E-19 | 73.12% | |
| G139991_k105_65923_20 | 31.20% | 79.337 | 9.10E-19 | 69.53% | |
| G48804_k105_2940_74 | 33.70% | 78.9518 | 9.12E-19 | 61.65% | |
| G48817_k105_181825_6 | 31.30% | 78.9518 | 9.42E-19 | 68.46% | |
| G140778_k105_22917_3 | 31.00% | 78.9518 | 9.98E-19 | 68.82% | |
| ERR2017523_k103_54949_7 | 27.00% | 78.9518 | 1.01E-18 | 74.91% | |
| CSM79HGV_P_R_k105_38368_7 | 31.30% | 79.337 | 1.03E-18 | 73.48% | |
| MSM79H98_R_k105_18235_68 | 31.20% | 78.9518 | 1.04E-18 | 76.34% | |
| ERR2017717_k103_24391_2 | 30.10% | 79.337 | 1.04E-18 | 66.31% | |
| G36380_k105_13375_15 | 33.20% | 78.9518 | 1.05E-18 | 67.74% | |
| G140839_k105_1033_1 | 32.70% | 78.5666 | 1.07E-18 | 70.97% | |
| HSM7J4IQ_R_k105_33839_1 | 32.90% | 78.9518 | 1.08E-18 | 60.93% | |
| CSM5MCZ3_R_k105_53031_66 | 30.70% | 78.9518 | 1.08E-18 | 67.38% | |
| MSM79HBR_R_k105_13912_60 | 34.50% | 78.9518 | 1.09E-18 | 59.14% | |
| ERR2017630_k103_46512_2 | 29.10% | 79.337 | 1.10E-18 | 75.27% | |
| CSM67U9H_P_R_k105_10905_3 | 30.70% | 78.9518 | 1.12E-18 | 67.38% | |
| G105082_k105_68803_2 | 30.70% | 78.9518 | 1.13E-18 | 68.10% | |
| G140117_k105_28751_140 | 29.70% | 78.9518 | 1.20E-18 | 67.74% | |
| G105095_k105_22590_1 | 30.10% | 78.9518 | 1.21E-18 | 68.10% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017704_k103_76394_3 | 32.30% | 78.9518 | 1.22E−18 | 68.46% | |
| ERR2017631_k103_52150_12 | 30.80% | 78.5666 | 1.22E−18 | 69.89% | |
| ERR2017529_k103_7226_4 | 31.30% | 78.5666 | 1.24E−18 | 68.46% | |
| G140840_k105_36078_3 | 29.70% | 78.9518 | 1.25E−18 | 68.46% | |
| G89162_k105_47625_2 | 30.70% | 78.5666 | 1.28E−18 | 67.38% | |
| G48812_k105_41366_2 | 30.10% | 78.5666 | 1.28E−18 | 68.82% | |
| ERR2017627_k103_567_1 | 31.90% | 78.5666 | 1.30E−18 | 68.10% | |
| G141047_k105_104615_3 | 30.70% | 78.5666 | 1.30E−18 | 67.74% | |
| G48814_k105_38059_3 | 31.80% | 78.5666 | 1.31E−18 | 68.46% | |
| G139981_k105_41444_2 | 29.50% | 78.5666 | 1.31E−18 | 68.46% | |
| G48780_k105_45296_49 | 30.60% | 78.5666 | 1.33E−18 | 68.82% | |
| G140117_k105_1273_36 | 28.40% | 78.5666 | 1.34E−18 | 68.10% | |
| ERR2017659_k103_13861_17 | 30.90% | 78.5666 | 1.35E−18 | 66.31% | |
| G140926_k105_36262_33 | 28.50% | 78.5666 | 1.37E−18 | 68.10% | |
| MSM9VZLN_R_k105_75483_2 | 26.40% | 78.9518 | 1.39E−18 | 72.76% | |
| HSM5MD4B_P_R_k105_11944_2 | 25.40% | 78.5666 | 1.41E−18 | 81.36% | |
| G105109_k105_59939_2 | 29.50% | 78.9518 | 1.48E−18 | 71.33% | |
| G141075_k105_28565_37 | 27.70% | 78.1814 | 1.48E−18 | 68.10% | |
| G48787_k105_50245_77 | 31.80% | 78.5666 | 1.49E−18 | 68.46% | |
| G48789_k105_76032_1 | 31.50% | 78.5666 | 1.52E−18 | 69.53% | |
| ERR2017736_k103_35998_2 | 30.00% | 78.5666 | 1.52E−18 | 70.25% | |
| G36356_k105_57170_9 | 28.10% | 78.5666 | 1.52E−18 | 68.46% | |
| G105008_k105_101226_2 | 30.60% | 78.5666 | 1.56E−18 | 67.74% | |
| ERR2017569_k103_125456_9 | 30.70% | 78.5666 | 1.60E−18 | 67.38% | |
| MSMA26DG_R_k105_19716_2 | 32.10% | 78.1814 | 1.73E−18 | 67.38% | |
| G104851_k105_21388_32 | 31.70% | 78.1814 | 1.84E−18 | 68.46% | |
| MSM79HBB_R_k105_49201_3 | 29.20% | 78.1814 | 1.86E−18 | 67.03% | |
| G48814_k105_29432_3 | 28.60% | 78.1814 | 1.86E−18 | 71.68% | |
| ERR2017553_k103_4307_36 | 28.30% | 78.1814 | 1.92E−18 | 78.14% | |
| ERR2017673_k103_45139_2 | 28.90% | 78.1814 | 1.95E−18 | 70.25% | |
| ERR2017631_k103_43743_9 | 29.60% | 78.1814 | 1.96E−18 | 70.25% | |
| G48812_k105_55617_2 | 30.10% | 78.1814 | 1.97E−18 | 68.46% | |
| MSM9VZMM_R_k105_17369_15 | 31.20% | 78.5666 | 2.03E−18 | 66.31% | |
| G48804_k105_10132_2 | 28.20% | 78.1814 | 2.03E−18 | 93.19% | |
| ERR2017555_k103_85037_15 | 29.90% | 77.7962 | 2.17E−18 | 69.18% | |
| G105000_k105_71576_26 | 29.60% | 78.1814 | 2.20E−18 | 67.38% | |
| G48812_k105_95414_5 | 28.80% | 78.1814 | 2.28E−18 | 82.80% | |
| ERR2017649_k103_23134_4 | 30.00% | 77.7962 | 2.35E−18 | 82.08% | |
| ERR2017554_k103_7348_6 | 30.10% | 77.7962 | 2.36E−18 | 66.31% | |
| ERR2017696_k103_15968_7 | 29.90% | 78.1814 | 2.39E−18 | 69.18% | |
| G140911_k105_7832_3 | 30.60% | 77.7962 | 2.41E−18 | 67.38% | |
| ERR2017653_k103_72195_2 | 31.20% | 77.7962 | 2.55E−18 | 68.46% | |
| ERR2017545_k103_41987_4 | 28.00% | 77.7962 | 2.58E−18 | 67.38% | |
| G48806_k105_14918_94 | 29.50% | 77.7962 | 2.60E−18 | 68.82% | |
| G89274_k105_28687_1 | 30.00% | 77.7962 | 2.64E−18 | 79.93% | |
| ERR2017609_k103_24441_1 | 25.70% | 77.7962 | 2.70E−18 | 66.67% | |
| G48817_k105_101539_6 | 29.70% | 77.7962 | 2.71E−18 | 68.46% | |
| G36363_k105_7228_13 | 28.00% | 77.7962 | 2.71E−18 | 82.80% | |
| MSMA26AZ_TR_R_k105_16815_2 | 28.60% | 77.7962 | 2.75E−18 | 71.33% | |
| G48790_k105_42687_3 | 31.10% | 77.411 | 2.87E−18 | 79.57% | |
| ERR2017579_k103_7547_7 | 30.00% | 77.411 | 2.93E−18 | 60.93% | |
| G104923_k105_16556_4 | 30.40% | 77.411 | 3.02E−18 | 69.18% | |
| G36385_k105_717_61 | 32.10% | 77.7962 | 3.05E−18 | 66.67% | |
| G48806_k105_9468_219 | 33.70% | 77.411 | 3.08E−18 | 61.65% | |
| G140776_k105_27903_2 | 31.20% | 77.411 | 3.24E−18 | 68.46% | |
| ERR2017570_k103_50999_3 | 30.10% | 77.7962 | 3.27E−18 | 67.74% | |
| PSM7J15Q_R_k105_1823_4 | 32.50% | 77.7962 | 3.29E−18 | 67.74% | |
| G36392_k105_47848_68 | 28.60% | 77.411 | 3.30E−18 | 68.46% | |
| G140138_k105_1098_1 | 31.00% | 77.411 | 3.33E−18 | 65.95% | |
| G89121_k105_44588_3 | 30.70% | 77.411 | 3.33E−18 | 70.61% | |
| G48798_k105_61937_1 | 30.90% | 77.7962 | 3.37E−18 | 70.25% | |
| ERR2017646_k103_40362_2 | 32.40% | 77.411 | 3.60E−18 | 62.01% | |
| G141074_k105_87157_4 | 30.50% | 77.411 | 3.61E−18 | 67.74% | |
| ERR2017659_k103_161416_10 | 30.20% | 77.411 | 3.61E−18 | 67.38% | |
| ERR2017661_k103_26588_8 | 30.40% | 77.411 | 3.77E−18 | 67.74% | |
| G48820_k105_10791_11 | 30.10% | 77.411 | 3.79E−18 | 67.74% | |
| ERR2017667_k103_86069_9 | 30.50% | 77.0258 | 3.86E−18 | 67.38% | |
| G140785_k105_4188_1 | 26.00% | 77.411 | 3.94E−18 | 81.36% | |
| ERR2017615_k103_1926_2 | 30.90% | 77.0258 | 4.12E−18 | 67.38% | |
| HSMA33KQ_R_k105_11652_2 | 30.10% | 77.411 | 4.23E−18 | 69.89% | |
| CSM5MCY8_R_k105_18625_2 | 30.00% | 77.0258 | 4.31E−18 | 68.10% | |
| G72718_k105_87329_2 | 30.40% | 77.0258 | 4.43E−18 | 71.33% | |
| ERR2017567_k103_35437_3 | 32.30% | 77.0258 | 4.51E−18 | 67.38% | |
| G104868_k105_9417_1 | 28.70% | 77.0258 | 4.52E−18 | 68.82% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48817__k105__9493__7 | 31.70% | 77.0258 | 4.71E−18 | 67.03% | |
| G141012__k105__1567__3 | 28.10% | 77.0258 | 4.76E−18 | 69.53% | |
| ERR2017565__k103__75451__77 | 29.10% | 77.0258 | 4.87E−18 | 67.03% | |
| ERR2017561__k103__51819__2 | 28.40% | 77.0258 | 4.91E−18 | 67.74% | |
| ERR2017696__k103__41202__3 | 29.40% | 77.0258 | 5.00E−18 | 71.33% | |
| G48819__k105__15450__22 | 30.90% | 77.0258 | 5.04E−18 | 66.67% | |
| MSM6J2K6__R__k105__46998__1 | 29.10% | 77.0258 | 5.13E−18 | 68.46% | |
| G88922__k105__60299__2 | 30.20% | 77.0258 | 5.19E−18 | 67.38% | |
| G48819__k105__8488__13 | 28.60% | 77.411 | 5.19E−18 | 68.46% | |
| G48793__k105__17157__96 | 29.50% | 76.6406 | 5.37E−18 | 68.82% | |
| G140046__k105__7512__1 | 30.60% | 77.0258 | 5.55E−18 | 66.31% | |
| ERR2017430__k93__8771__2 | 31.20% | 76.6406 | 5.73E−18 | 68.46% | |
| G48838__k105__78496__1 | 26.50% | 77.0258 | 5.81E−18 | 69.53% | |
| ERR2017575__k103__85655__2 | 30.10% | 77.0258 | 5.82E−18 | 67.74% | |
| ERR2017485__k79__10812__2 | 31.00% | 76.6406 | 5.98E−18 | 68.82% | |
| G140946__k105__11013__8 | 31.80% | 76.6406 | 6.11E−18 | 68.46% | |
| G141033__k105__22846__2 | 30.10% | 76.6406 | 6.24E−18 | 68.46% | |
| G48783__k105__4609__58 | 29.20% | 77.411 | 6.51E−18 | 68.46% | |
| ERR2017591__k103__44083__2 | 30.40% | 76.6406 | 6.67E−18 | 69.18% | |
| G48832__k105__34466__21 | 32.30% | 76.6406 | 6.68E−18 | 67.03% | |
| G48839__k105__61769__6 | 29.50% | 76.6406 | 6.93E−18 | 67.74% | |
| G72716__k105__24937__2 | 27.90% | 76.6406 | 7.06E−18 | 75.63% | |
| ERR2017636__k103__14328__5 | 30.30% | 76.6406 | 7.16E−18 | 69.53% | |
| G72728__k105__70582__21 | 30.40% | 76.2554 | 7.20E−18 | 69.18% | |
| ERR2017639__k103__20019__5 | 30.70% | 76.2554 | 7.23E−18 | 68.46% | |
| G141011__k105__17791__2 | 30.50% | 76.6406 | 7.23E−18 | 69.53% | |
| ERR2017478__k79__27058__2 | 28.30% | 76.6406 | 7.24E−18 | 72.76% | |
| CSM5MCWQ__R__k105__13885__2 | 27.60% | 76.2554 | 7.37E−18 | 68.46% | |
| G72679__k105__11881__23 | 27.90% | 76.6406 | 7.45E−18 | 70.25% | |
| HSM5MD7U__R__k105__10271__2 | 25.10% | 76.6406 | 7.49E−18 | 66.67% | |
| G140847__k105__1511__130 | 28.40% | 76.6406 | 7.57E−18 | 67.74% | |
| ERR2017649__k103__38406__4 | 30.70% | 76.6406 | 7.60E−18 | 67.74% | |
| ERR2017639__k103__56786__2 | 29.90% | 76.6406 | 7.71E−18 | 69.18% | |
| ERR2017692__k103__59563__17 | 28.60% | 76.2554 | 7.77E−18 | 68.46% | |
| ERR2017640__k103__57642__11 | 29.40% | 76.2554 | 7.90E−18 | 68.46% | |
| ERR2017631__k103__74155__6 | 30.70% | 76.2554 | 8.29E−18 | 68.46% | |
| ERR2017552__k103__40643__2 | 33.50% | 77.411 | 8.52E−18 | 67.74% | |
| G141101__k105__37692__2 | 31.20% | 76.2554 | 9.01E−18 | 69.89% | |
| ERR2017628__k103__89324__2 | 25.70% | 76.2554 | 9.19E−18 | 66.67% | |
| G89181__k105__10605__13 | 29.70% | 76.6406 | 9.26E−18 | 69.53% | |
| MSM9VZNH__R__k105__50637__2 | 30.70% | 76.2554 | 9.27E−18 | 68.46% | |
| G141033__k105__50684__2 | 30.90% | 76.2554 | 9.48E−18 | 67.03% | |
| G140028__k105__95793__2 | 26.80% | 75.8702 | 9.74E−18 | 85.66% | |
| CSM7KOLY__R__k105__23631__22 | 29.70% | 75.8702 | 1.01E−17 | 68.46% | |
| G139957__k105__59731__160 | 26.40% | 76.6406 | 1.04E−17 | 89.61% | |
| ERR2017529__k103__320__16 | 28.60% | 75.8702 | 1.06E−17 | 68.46% | |
| G48777__k105__58599__4 | 32.40% | 75.8702 | 1.07E−17 | 60.93% | |
| ERR2017665__k103__63019__2 | 28.70% | 75.8702 | 1.08E−17 | 78.85% | |
| PSM7J15A__R__k105__10152__2 | 29.70% | 75.8702 | 1.09E−17 | 71.68% | |
| G140174__k105__28044__2 | 33.70% | 75.8702 | 1.11E−17 | 59.50% | |
| G36387__k105__17027__2 | 31.20% | 75.8702 | 1.14E−17 | 69.89% | |
| G72703__k105__26569__3 | 30.20% | 75.8702 | 1.14E−17 | 69.53% | |
| ERR2017588__k103__108861__1 | 30.00% | 75.8702 | 1.14E−17 | 67.74% | |
| G104834__k105__42339__23 | 32.40% | 75.8702 | 1.17E−17 | 59.86% | |
| G89098__k105__42465__2 | 31.60% | 75.8702 | 1.19E−17 | 68.46% | |
| ERR2017450__k93__49825__2 | 29.20% | 75.8702 | 1.20E−17 | 68.46% | |
| ERR2017630__k103__27421__2 | 27.70% | 75.8702 | 1.20E−17 | 69.89% | |
| G141111__k105__50887__3 | 28.40% | 75.8702 | 1.21E−17 | 74.91% | |
| G140896__k105__60581__1 | 31.00% | 75.8702 | 1.22E−17 | 68.82% | |
| G48796__k105__118317__45 | 32.70% | 75.8702 | 1.25E−17 | 60.93% | |
| ERR2017603__k103__31149__3 | 30.70% | 75.485 | 1.31E−17 | 68.46% | |
| G72678__k105__7293__14 | 33.70% | 75.485 | 1.32E−17 | 71.33% | |
| G36361__k105__35924__12 | 25.10% | 75.8702 | 1.35E−17 | 66.67% | |
| G48812__k105__28378__2 | 29.80% | 75.8702 | 1.38E−17 | 66.31% | |
| G72701__k105__37191__6 | 29.10% | 75.485 | 1.38E−17 | 67.38% | |
| HSMA33KQ__R__k105__5162__3 | 25.50% | 75.8702 | 1.39E−17 | 90.32% | |
| G48802__k105__59965__8 | 30.60% | 77.0258 | 1.40E−17 | 72.76% | |
| CSM67UAA__R__k105__9341__98 | 30.90% | 75.8702 | 1.41E−17 | 68.46% | |
| G48822__k105__3561__1 | 29.30% | 75.8702 | 1.43E−17 | 73.48% | |
| CSM7KORK__R__k105__22529__2 | 30.40% | 75.8702 | 1.44E−17 | 68.10% | |
| CSMA9J65__R__k105__5457__4 | 32.30% | 75.485 | 1.45E−17 | 68.46% | |
| G36347__k105__12488__64 | 28.80% | 75.8702 | 1.53E−17 | 73.12% | |
| G140158__k105__24836__2 | 30.20% | 75.485 | 1.57E−17 | 68.46% | |
| G36386__k105__33690__2 | 30.50% | 75.8702 | 1.60E−17 | 68.46% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017513_k79_22366_16 | 30.00% | 75.485 | 1.62E-17 | 67.74% | |
| ERR2017731_k103_29660_2 | 28.70% | 75.8702 | 1.64E-17 | 67.03% | |
| G72710_k105_20611_6 | 33.90% | 75.485 | 1.65E-17 | 60.93% | |
| G139994_k105_31550_2 | 30.40% | 75.485 | 1.65E-17 | 68.10% | |
| G141070_k105_56169_3 | 29.70% | 75.485 | 1.66E-17 | 68.46% | |
| ERR2017547_k103_31831_32 | 29.00% | 75.485 | 1.70E-17 | 68.82% | |
| ERR2017613_k103_23170_12 | 29.00% | 75.485 | 1.74E-17 | 72.40% | |
| G88847_k105_17327_2 | 31.00% | 75.0998 | 1.82E-17 | 68.82% | |
| G104953_k105_31882_18 | 30.40% | 75.8702 | 1.82E-17 | 68.46% | |
| ERR2017729_k103_96573_1 | 32.50% | 75.0998 | 1.95E-17 | 68.10% | |
| ERR2017720_k103_27620_3 | 29.20% | 75.485 | 1.95E-17 | 68.10% | |
| CSM79HNI_R_k105_14150_9 | 32.40% | 75.0998 | 1.98E-17 | 67.03% | |
| HSM7CYY3_R_k105_7873_1 | 31.60% | 75.0998 | 2.04E-17 | 71.68% | |
| G140963_k105_60434_10 | 31.20% | 75.0998 | 2.07E-17 | 69.53% | |
| ERR2017525_k103_126715_5 | 30.50% | 75.0998 | 2.08E-17 | 68.82% | |
| G140812_k105_24526_16 | 29.60% | 75.0998 | 2.09E-17 | 69.53% | |
| G141104_k105_29546_8 | 30.70% | 75.0998 | 2.11E-17 | 70.61% | |
| HSMA33KS_R_k105_33081_1 | 29.50% | 75.485 | 2.22E-17 | 67.74% | |
| G105114_k105_41340_2 | 30.30% | 74.7114 | 2.27E-17 | 65.95% | |
| HSM7CYZ7_R_k105_6563_2 | 30.30% | 75.0998 | 2.28E-17 | 68.46% | |
| PSMA2675_R_k105_1833_3 | 27.30% | 75.485 | 2.28E-17 | 88.17% | |
| G140130_k105_2894_2 | 30.10% | 75.0998 | 2.40E-17 | 67.74% | |
| G105031_k105_28514_2 | 29.50% | 75.0998 | 2.40E-17 | 72.40% | |
| PSM7J19T_R_k105_32534_2 | 31.70% | 75.0998 | 2.49E-17 | 66.31% | |
| ERR2017615_k103_14852_1 | 28.60% | 74.7146 | 2.49E-17 | 68.46% | |
| ERR2017542_k103_45310_9 | 33.30% | 74.7146 | 2.51E-17 | 68.46% | |
| G105114_k105_12242_2 | 31.10% | 75.0998 | 2.52E-17 | 67.74% | |
| ERR2017729_k103_147811_16 | 30.30% | 74.7146 | 2.55E-17 | 67.03% | |
| G140794_k105_14819_8 | 29.70% | 74.7146 | 2.59E-17 | 69.53% | |
| G36349_k105_11369_2 | 33.50% | 75.0998 | 2.61E-17 | 68.82% | |
| G140046_k105_9728_57 | 29.70% | 74.7146 | 2.68E-17 | 67.74% | |
| G139989_k105_81433_6 | 26.80% | 74.7146 | 2.74E-17 | 68.82% | |
| G36394_k105_47440_1 | 29.00% | 74.7146 | 2.79E-17 | 67.74% | |
| G48812_k105_25551_2 | 29.90% | 74.7146 | 2.88E-17 | 67.03% | |
| CSM7KOS7_R_k105_27908_15 | 30.40% | 75.485 | 2.98E-17 | 75.99% | |
| HSM7J4MS_R_k105_13677_1 | 32.30% | 74.7146 | 3.04E-17 | 68.46% | |
| G48806_k105_25902_4 | 27.50% | 74.7146 | 3.23E-17 | 87.10% | |
| G72694_k105_45049_13 | 28.50% | 74.7146 | 3.27E-17 | 68.82% | |
| G88745_k105_86553_4 | 29.40% | 74.7146 | 3.30E-17 | 70.61% | |
| G48842_k105_22347_3 | 32.70% | 74.3294 | 3.53E-17 | 70.61% | |
| G140064_k105_36251_3 | 29.70% | 74.7146 | 3.53E-17 | 67.74% | |
| G89094_k105_2233_3 | 31.30% | 75.0998 | 3.56E-17 | 69.18% | |
| ERR2017611_k103_101768_2 | 29.70% | 74.7146 | 3.63E-17 | 68.46% | |
| G140083_k105_31440_2 | 26.90% | 74.7146 | 3.71E-17 | 68.82% | |
| G104845_k105_18262_6 | 27.50% | 74.3294 | 3.76E-17 | 67.38% | |
| G141111_k105_1068_1 | 30.00% | 74.7146 | 3.77E-17 | 67.74% | |
| G88971_k105_22187_3 | 30.50% | 75.485 | 3.82E-17 | 69.53% | |
| G36347_k105_4358_97 | 31.40% | 74.3294 | 3.87E-17 | 68.10% | |
| G140062_k105_21215_9 | 30.70% | 74.3294 | 4.07E-17 | 69.18% | |
| G48838_k105_115785_3 | 30.90% | 74.3294 | 4.11E-17 | 70.97% | |
| G140174_k105_28629_4 | 29.20% | 74.3294 | 4.20E-17 | 68.46% | |
| ERR2017708_k103_82617_31 | 31.20% | 74.7146 | 4.21E-17 | 66.31% | |
| G89027_k105_33505_17 | 29.30% | 74.3294 | 4.22E-17 | 71.68% | |
| G140941_k105_26650_24 | 27.70% | 74.7146 | 4.23E-17 | 77.78% | |
| G48798_k105_40920_33 | 31.30% | 74.7146 | 4.33E-17 | 67.38% | |
| PSM7J1C4_R_k105_34594_4 | 29.70% | 74.3294 | 4.35E-17 | 67.74% | |
| ERR2017665_k103_48093_11 | 30.60% | 74.3294 | 4.37E-17 | 60.93% | |
| G72673_k105_48013_51 | 31.30% | 74.3294 | 4.38E-17 | 67.38% | |
| G140928_k105_58936_9 | 27.30% | 74.3294 | 4.38E-17 | 72.76% | |
| PSMB4MBK_R_k105_47933_2 | 28.00% | 74.3294 | 4.40E-17 | 68.82% | |
| G140004_k105_69058_5 | 30.10% | 74.3294 | 4.44E-17 | 68.46% | |
| PSMB4MBK_R_k105_2030_5 | 29.20% | 74.3294 | 4.44E-17 | 68.46% | |
| G141038_k105_1355_2 | 29.00% | 74.3294 | 4.44E-17 | 68.82% | |
| G140974_k105_29066_3 | 29.90% | 74.7146 | 4.52E-17 | 68.46% | |
| G36362_k105_56067_1 | 27.30% | 74.3294 | 4.63E-17 | 72.76% | |
| G140130_k105_69611_44 | 29.70% | 74.3294 | 4.69E-17 | 68.46% | |
| G139981_k105_50127_24 | 31.00% | 74.3294 | 4.75E-17 | 70.25% | |
| MSMA2688_R_k105_44408_1 | 30.60% | 74.3294 | 4.79E-17 | 66.31% | |
| G48807_k105_67367_2 | 33.20% | 73.9442 | 4.85E-17 | 68.10% | |
| CSM5MCV1_P_R_k105_8313_1 | 28.90% | 74.3294 | 4.93E-17 | 71.33% | |
| G140929_k105_22538_2 | 29.70% | 73.9442 | 5.02E-17 | 68.46% | |
| ERR2017531_k103_73850_3 | 29.90% | 73.9442 | 5.12E-17 | 68.46% | |
| ERR2017560_k103_31723_132 | 26.80% | 74.3294 | 5.16E-17 | 69.18% | |
| ERR2017467_k103_57239_53 | 31.40% | 73.9442 | 5.23E-17 | 66.67% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48814_k105_41735_16 | 30.40% | 73.9442 | 5.42E−17 | 68.46% | |
| ERR2017438_k93_17261_2 | 29.40% | 73.9442 | 5.57E−17 | 60.93% | |
| G105106_k105_73799_3 | 30.30% | 73.9442 | 5.72E−17 | 68.46% | |
| G48812_k105_74869_4 | 29.90% | 73.9442 | 5.72E−17 | 71.33% | |
| ERR2017671_k103_28810_2 | 31.20% | 73.9442 | 5.74E−17 | 60.93% | |
| G72705_k105_82220_6 | 28.00% | 74.3294 | 5.74E−17 | 75.99% | |
| G48806_k105_15212_1 | 28.60% | 73.9442 | 5.96E−17 | 87.46% | |
| G104848_k105_66284_59 | 30.40% | 74.3294 | 6.13E−17 | 68.46% | |
| G140918_k105_10126_15 | 27.60% | 74.3294 | 6.13E−17 | 68.46% | |
| G48820_k105_13546_15 | 28.90% | 73.9442 | 6.53E−17 | 72.76% | |
| ERR2017467_k103_139125_2 | 32.10% | 73.559 | 6.60E−17 | 69.53% | |
| MSM9VZF7_R_k105_48462_235 | 29.40% | 73.559 | 6.60E−17 | 79.93% | |
| G48794_k105_122196_1 | 30.70% | 73.559 | 6.68E−17 | 67.38% | |
| G72705_k105_13805_1 | 26.50% | 73.559 | 6.69E−17 | 67.38% | |
| G48796_k105_110428_17 | 31.00% | 73.559 | 6.82E−17 | 66.67% | |
| G140853_k105_22848_7 | 27.60% | 73.559 | 7.10E−17 | 68.46% | |
| MSM9VZIQ_R_k105_46797_3 | 31.40% | 73.559 | 7.18E−17 | 67.03% | |
| G48792_k105_71109_5 | 29.10% | 73.559 | 7.18E−17 | 70.97% | |
| G36358_k105_61218_22 | 34.70% | 73.559 | 7.38E−17 | 60.93% | |
| G88977_k105_29795_4 | 32.30% | 73.9442 | 7.44E−17 | 67.03% | |
| G48791_k105_52020_2 | 29.30% | 73.559 | 7.56E−17 | 73.84% | |
| G104876_k105_48921_2 | 27.30% | 74.7146 | 7.94E−17 | 69.53% | |
| G72678_k105_38070_58 | 30.80% | 73.559 | 8.06E−17 | 68.10% | |
| G36392_k105_26849_1 | 26.50% | 73.559 | 8.56E−17 | 69.53% | |
| G89274_k105_23131_2 | 26.50% | 73.1738 | 8.69E−17 | 67.38% | |
| ERR2017631_k103_46747_36 | 30.20% | 73.1738 | 9.00E−17 | 69.53% | |
| ERR2017665_k103_38533_6 | 28.70% | 73.559 | 9.07E−17 | 62.01% | |
| G48842_k105_5799_2 | 26.30% | 73.9442 | 9.07E−17 | 82.44% | |
| G72682_k105_33380_1 | 24.00% | 73.559 | 9.16E−17 | 68.46% | |
| ERR2017634_k103_26420_71 | 28.90% | 73.1738 | 9.37E−17 | 66.67% | |
| G140114_k105_36925_5 | 33.70% | 73.559 | 9.58E−17 | 60.57% | |
| G104819_k105_57718_1 | 30.70% | 73.1738 | 9.58E−17 | 68.46% | |
| G139967_k105_11935_5 | 28.60% | 73.1738 | 9.68E−17 | 67.74% | |
| G141100_k105_40015_1 | 31.10% | 73.1738 | 1.00E−16 | 68.10% | |
| PSMA264W_R_k105_14772_1 | 29.40% | 73.1738 | 1.01E−16 | 68.46% | |
| ERR2017579_k103_124057_15 | 31.30% | 73.9442 | 1.02E−16 | 69.18% | |
| G104908_k105_22979_1 | 27.60% | 73.1738 | 1.05E−16 | 68.46% | |
| MSM79HAJ_R_k105_43872_3 | 28.20% | 73.1738 | 1.07E−16 | 72.76% | |
| ERR2017729_k103_10463_4 | 30.60% | 73.1738 | 1.11E−16 | 61.65% | |
| G140066_k105_33923_60 | 28.90% | 73.1738 | 1.11E−16 | 69.18% | |
| CSM67UB3_R_k105_36722_1 | 29.10% | 73.559 | 1.12E−16 | 71.68% | |
| ERR2017714_k103_34019_6 | 30.80% | 73.1738 | 1.13E−16 | 65.59% | |
| G36368_k105_10498_26 | 28.10% | 73.1738 | 1.15E−16 | 68.46% | |
| G48831_k105_99278_1 | 29.80% | 73.1738 | 1.18E−16 | 67.03% | |
| ERR2017586_k103_34313_1 | 29.40% | 72.7886 | 1.18E−16 | 60.93% | |
| ERR2017622_k103_28892_5 | 29.70% | 73.559 | 1.19E−16 | 74.19% | |
| CSM67UAA_R_k105_4547_2 | 33.00% | 73.1738 | 1.21E−16 | 67.74% | |
| MSM5LLF2_P_R_k105_7521_1 | 31.40% | 72.7886 | 1.22E−16 | 60.93% | |
| ERR2017733_k103_40423_1 | 27.30% | 73.1738 | 1.24E−16 | 72.76% | |
| ERR2017596_k103_15764_10 | 31.40% | 73.9442 | 1.25E−16 | 68.10% | |
| G89190_k105_61505_2 | 28.10% | 73.1738 | 1.26E−16 | 70.25% | |
| G140010_k105_23406_12 | 28.10% | 72.7886 | 1.27E−16 | 68.46% | |
| ERR2017541_k103_1333_35 | 31.80% | 72.7886 | 1.29E−16 | 67.38% | |
| ERR2017645_k103_8615_2 | 30.20% | 72.7886 | 1.29E−16 | 69.53% | |
| G105012_k105_23488_2 | 28.70% | 72.7886 | 1.34E−16 | 67.03% | |
| G48793_k105_165811_2 | 29.10% | 72.7886 | 1.37E−16 | 69.53% | |
| G140166_k105_29852_2 | 29.20% | 72.7886 | 1.38E−16 | 68.46% | |
| G48791_k105_172039_1 | 28.40% | 72.7886 | 1.39E−16 | 74.19% | |
| G48838_k105_62400_3 | 29.80% | 72.7886 | 1.40E−16 | 67.74% | |
| MSM5LLIC_P_R_k105_75349_10 | 31.80% | 72.7886 | 1.44E−16 | 66.67% | |
| G140953_k105_120914_2 | 29.90% | 72.7886 | 1.50E−16 | 67.74% | |
| G140842_k105_98923_2 | 30.40% | 72.4034 | 1.54E−16 | 67.74% | |
| G140044_k105_50730_3 | 29.00% | 72.7886 | 1.54E−16 | 70.97% | |
| G105037_k105_8994_1 | 28.80% | 72.7886 | 1.54E−16 | 70.61% | |
| ERR2017675_k103_105871_2 | 30.80% | 72.7886 | 1.58E−16 | 68.46% | |
| ERR2017651_k103_27728_1 | 31.60% | 73.1738 | 1.59E−16 | 67.74% | |
| ERR2017685_k103_54893_9 | 29.90% | 72.7886 | 1.61E−16 | 68.46% | |
| G105114_k105_13509_13 | 30.80% | 72.4034 | 1.62E−16 | 65.95% | |
| ERR2017692_k103_64673_14 | 30.30% | 72.4034 | 1.64E−16 | 66.67% | |
| ERR2017551_k103_58834_2 | 30.00% | 72.4034 | 1.64E−16 | 60.93% | |
| ERR2017675_k103_2518_13 | 29.10% | 72.4034 | 1.69E−16 | 79.57% | |
| G89065_k105_21198_7 | 32.30% | 72.4034 | 1.73E−16 | 66.31% | |
| ERR2017652_k103_132156_1 | 31.00% | 73.559 | 1.79E−16 | 74.19% | |
| G141121_k105_45918_4 | 26.90% | 73.559 | 1.79E−16 | 69.53% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G104864_k105_39055_5 | 29.90% | 72.4034 | 1.81E−16 | 68.82% | |
| G140990_k105_23667_1 | 29.40% | 72.4034 | 1.81E−16 | 69.53% | |
| MSM79H81_R_k105_297_2 | 29.40% | 72.4034 | 1.83E−16 | 71.68% | |
| G104817_k105_46932_2 | 27.60% | 72.4034 | 1.86E−16 | 67.74% | |
| G104950_k105_35992_3 | 31.80% | 72.4034 | 1.94E−16 | 67.03% | |
| ERR2017470_k103_59428_1 | 29.40% | 72.4034 | 1.96E−16 | 75.27% | |
| G48817_k105_85681_52 | 31.10% | 72.4034 | 1.99E−16 | 67.74% | |
| G141049_k105_5901_1 | 33.90% | 72.7886 | 2.00E−16 | 66.67% | |
| G36371_k105_20134_2 | 28.60% | 72.4034 | 2.03E−16 | 67.38% | |
| G140844_k105_28329_2 | 29.00% | 72.7886 | 2.04E−16 | 66.31% | |
| ERR2017629_k103_66774_5 | 29.70% | 72.4034 | 2.11E−16 | 68.46% | |
| ERR2017618_k103_5325_51 | 30.10% | 72.4034 | 2.22E−16 | 68.10% | |
| MSM6J2HT_R_k105_19441_2 | 29.80% | 72.4034 | 2.22E−16 | 68.10% | |
| ERR2017615_k103_3682_23 | 29.80% | 72.4034 | 2.27E−16 | 73.12% | |
| HSM67VDP_R_k105_1954_2 | 29.40% | 72.4034 | 2.29E−16 | 72.76% | |
| ERR2017460_k93_8951_28 | 28.80% | 72.0182 | 2.36E−16 | 68.10% | |
| G89146_k105_48867_8 | 27.90% | 72.0182 | 2.36E−16 | 71.33% | |
| CSM5FZ3Z_P_R_k105_21061_2 | 30.90% | 72.4034 | 2.37E−16 | 72.40% | |
| G140037_k105_108806_1 | 29.70% | 72.0182 | 2.37E−16 | 67.74% | |
| G140946_k105_101605_4 | 28.90% | 72.0182 | 2.43E−16 | 68.82% | |
| G72714_k105_52650_12 | 28.60% | 72.0182 | 2.43E−16 | 69.89% | |
| MSM6J2ML_R_k105_5326_1 | 28.10% | 72.0182 | 2.50E−16 | 67.74% | |
| ERR2017592_k103_37689_4 | 27.00% | 72.4034 | 2.75E−16 | 88.53% | |
| G48799_k105_13424_3 | 31.30% | 72.0182 | 2.76E−16 | 74.55% | |
| HSM7J4JH_R_k105_14118_58 | 31.80% | 72.0182 | 2.87E−16 | 60.93% | |
| G140004_k105_20922_4 | 27.80% | 72.0182 | 2.98E−16 | 70.61% | |
| ERR2017696_k103_37858_5 | 30.60% | 71.633 | 3.02E−16 | 60.93% | |
| ERR2017641_k103_42292_126 | 29.90% | 72.0182 | 3.04E−16 | 81.00% | |
| G141115_k105_109409_10 | 27.60% | 72.0182 | 3.06E−16 | 88.53% | |
| G72704_k105_35507_2 | 29.60% | 71.633 | 3.15E−16 | 67.38% | |
| G48826_k105_121634_114 | 29.60% | 72.0182 | 3.16E−16 | 67.03% | |
| ERR2017543_k103_42400_53 | 29.20% | 72.0182 | 3.16E−16 | 68.46% | |
| ERR2017639_k103_41642_3 | 30.30% | 71.633 | 3.18E−16 | 67.38% | |
| G48806_k105_6474_2 | 29.10% | 72.0182 | 3.24E−16 | 79.93% | |
| G139969_k105_67207_2 | 28.80% | 71.633 | 3.24E−16 | 70.97% | |
| G140878_k105_1326_2 | 28.80% | 71.633 | 3.27E−16 | 68.10% | |
| ERR2017472_k79_29458_1 | 30.30% | 71.633 | 3.32E−16 | 68.46% | |
| ERR2017681_k103_69143_1 | 27.50% | 71.633 | 3.33E−16 | 67.74% | |
| ERR2017662_k103_5798_7 | 28.60% | 72.0182 | 3.34E−16 | 69.53% | |
| ERR2017532_k103_56479_6 | 33.70% | 72.0182 | 3.37E−16 | 60.57% | |
| G105056_k105_87698_2 | 29.60% | 71.633 | 3.47E−16 | 68.46% | |
| G48817_k105_18221_3 | 32.70% | 71.633 | 3.48E−16 | 69.53% | |
| G140198_k105_80297_1 | 28.60% | 71.633 | 3.54E−16 | 69.89% | |
| G36349_k105_24981_2 | 29.70% | 71.633 | 3.57E−16 | 68.46% | |
| ERR2017482_k79_97630_2 | 29.90% | 71.633 | 3.76E−16 | 68.82% | |
| ERR2017683_k103_72749_36 | 28.30% | 71.633 | 3.78E−16 | 69.89% | |
| G139955_k105_37242_1 | 26.90% | 71.633 | 3.81E−16 | 74.55% | |
| G48821_k105_7671_13 | 31.20% | 71.633 | 3.95E−16 | 60.93% | |
| G36357_k105_33008_25 | 28.60% | 71.633 | 3.96E−16 | 70.97% | |
| ERR2017686_k103_15973_13 | 29.90% | 71.633 | 4.00E−16 | 65.95% | |
| G141022_k105_9452_2 | 28.60% | 71.2478 | 4.09E−16 | 68.82% | |
| ERR2017686_k103_70767_3 | 31.10% | 71.633 | 4.26E−16 | 68.46% | |
| G89273_k105_100810_11 | 30.40% | 71.2478 | 4.38E−16 | 67.38% | |
| CSM7KOS7_R_k105_38487_2 | 29.50% | 71.2478 | 4.42E−16 | 67.74% | |
| CSM7KOS7_R_k105_32171_23 | 30.00% | 71.2478 | 4.56E−16 | 72.40% | |
| G141072_k105_3486_5 | 27.20% | 71.2478 | 4.71E−16 | 68.46% | |
| ERR2017499_k103_47195_7 | 32.50% | 71.2478 | 4.73E−16 | 67.74% | |
| ERR2017553_k103_35130_4 | 28.10% | 71.2478 | 4.76E−16 | 69.89% | |
| G140010_k105_57627_4 | 31.20% | 71.2478 | 5.02E−16 | 60.93% | |
| G72705_k105_67941_3 | 28.10% | 71.2478 | 5.10E−16 | 68.10% | |
| ERR2017715_k103_76704_238 | 29.40% | 71.633 | 5.11E−16 | 68.46% | |
| G36370_k105_2703_6 | 29.20% | 71.2478 | 5.17E−16 | 87.81% | |
| G139981_k105_33639_1 | 28.10% | 71.2478 | 5.28E−16 | 67.03% | |
| G140978_k105_63578_1 | 29.90% | 71.2478 | 5.31E−16 | 74.55% | |
| G88977_k105_52915_6 | 28.90% | 71.2478 | 5.46E−16 | 68.46% | |
| G104823_k105_6038_3 | 29.40% | 71.2478 | 5.58E−16 | 76.34% | |
| G88922_k105_31346_4 | 26.30% | 71.2478 | 5.62E−16 | 72.76% | |
| ERR2017589_k103_30004_2 | 30.90% | 71.2478 | 5.65E−16 | 68.46% | |
| G140785_k105_27068_4 | 31.20% | 71.633 | 5.67E−16 | 68.46% | |
| G140964_k105_42289_4 | 26.90% | 71.633 | 5.67E−16 | 66.67% | |
| ERR2017616_k103_40933_3 | 29.80% | 71.2478 | 5.68E−16 | 59.50% | |
| ERR2017546_k103_42352_1 | 30.00% | 70.8626 | 5.71E−16 | 60.93% | |
| ERR2017607_k103_771_7 | 27.40% | 71.2478 | 5.78E−16 | 70.25% | |
| G140815_k105_17357_1 | 28.80% | 70.8626 | 5.83E−16 | 60.93% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48780_k105_5632_22 | 28.50% | 71.2478 | 5.89E-16 | 72.40% | |
| ERR2017590_k103_24140_5 | 30.00% | 70.8626 | 5.95E-16 | 60.93% | |
| G105028_k105_26718_13 | 30.30% | 71.2478 | 6.05E-16 | 67.03% | |
| G72682_k105_65246_2 | 27.80% | 70.8626 | 6.06E-16 | 82.44% | |
| ERR2017503_k79_95428_2 | 31.00% | 70.8626 | 6.10E-16 | 60.93% | |
| G140935_k105_19864_1 | 29.90% | 70.8626 | 6.19E-16 | 68.82% | |
| G48780_k105_27701_9 | 27.20% | 71.2478 | 6.21E-16 | 68.82% | |
| G140123_k105_94472_13 | 30.20% | 70.8626 | 6.27E-16 | 67.38% | |
| G140853_k105_81403_12 | 29.40% | 70.8626 | 6.29E-16 | 60.93% | |
| MSM9VZHF_R_k105_24116_10 | 31.20% | 70.8626 | 6.41E-16 | 72.40% | |
| G48786_k105_13537_5 | 27.20% | 71.2478 | 6.53E-16 | 89.25% | |
| G140812_k105_74353_12 | 27.50% | 70.8626 | 6.65E-16 | 70.97% | |
| G141126_k105_108681_4 | 28.40% | 70.8626 | 6.76E-16 | 67.74% | |
| G72679_k105_8292_24 | 30.60% | 70.8626 | 6.96E-16 | 76.34% | |
| G48842_k105_48485_10 | 30.60% | 70.8626 | 7.05E-16 | 60.93% | |
| G104829_k105_55725_2 | 29.30% | 70.8626 | 7.18E-16 | 67.03% | |
| MSM6J2JN_R_k105_26390_3 | 29.40% | 70.8626 | 7.26E-16 | 70.97% | |
| G72703_k105_93504_221 | 30.70% | 70.8626 | 7.29E-16 | 67.38% | |
| G140878_k105_42061_6 | 31.90% | 70.8626 | 7.61E-16 | 66.67% | |
| G48784_k105_9215_6 | 30.00% | 70.8626 | 7.75E-16 | 67.74% | |
| ERR2017639_k103_41282_3 | 26.80% | 70.8626 | 7.76E-16 | 67.38% | |
| G141126_k105_78436_9 | 27.80% | 70.8626 | 7.81E-16 | 69.89% | |
| G48823_k105_22307_8 | 28.90% | 70.4774 | 7.86E-16 | 68.46% | |
| ERR2017465_k103_36271_2 | 29.20% | 71.2478 | 7.94E-16 | 68.46% | |
| ERR2017576_k103_30046_58 | 28.40% | 70.8626 | 8.23E-16 | 68.46% | |
| G141111_k105_77307_1 | 31.00% | 70.4774 | 8.25E-16 | 82.44% | |
| G48792_k105_43316_2 | 32.00% | 70.4774 | 8.31E-16 | 68.46% | |
| G141069_k105_86012_2 | 30.00% | 70.8626 | 8.36E-16 | 53.41% | |
| ERR2017581_k103_111654_9 | 28.60% | 70.4774 | 8.48E-16 | 68.46% | |
| G48780_k105_59164_29 | 30.10% | 71.2478 | 8.69E-16 | 68.82% | |
| ERR2017519_k103_62300_2 | 28.70% | 70.8626 | 8.70E-16 | 59.14% | |
| ERR2017729_k103_69352_9 | 29.50% | 71.2478 | 9.07E-16 | 67.38% | |
| G140004_k105_4550_2 | 29.50% | 70.4774 | 9.49E-16 | 72.76% | |
| ERR2017697_k103_6305_6 | 28.20% | 70.4774 | 9.69E-16 | 68.46% | |
| MSM79HFY_R_k105_21547_2 | 31.10% | 70.8626 | 1.02E-15 | 66.67% | |
| ERR2017592_k103_16547_2 | 30.10% | 70.4774 | 1.03E-15 | 72.40% | |
| G140944_k105_16781_2 | 28.70% | 70.4774 | 1.03E-15 | 68.82% | |
| G105060_k105_55730_7 | 29.40% | 70.4774 | 1.05E-15 | 65.59% | |
| ERR2017569_k103_48771_95 | 29.90% | 70.4774 | 1.06E-15 | 69.18% | |
| HSMA33IE_R_k105_11891_7 | 30.50% | 70.4774 | 1.08E-15 | 70.25% | |
| G48791_k105_90596_2 | 29.10% | 70.0922 | 1.09E-15 | 67.38% | |
| CSM7KOMT_R_k105_28504_3 | 30.70% | 70.4774 | 1.11E-15 | 68.46% | |
| G48819_k105_13403_4 | 27.60% | 70.8626 | 1.12E-15 | 60.93% | |
| ERR2017659_k103_167409_2 | 29.10% | 70.0922 | 1.15E-15 | 69.89% | |
| G140856_k105_25451_6 | 29.00% | 70.4774 | 1.15E-15 | 67.74% | |
| ERR2017645_k103_27071_3 | 28.70% | 70.0922 | 1.16E-15 | 68.46% | |
| G88922_k105_31372_2 | 30.00% | 70.4774 | 1.18E-15 | 68.46% | |
| G48836_k105_297_13 | 28.60% | 70.4774 | 1.18E-15 | 87.46% | |
| G140126_k105_56160_25 | 31.40% | 70.0922 | 1.19E-15 | 70.61% | |
| G36355_k105_45725_3 | 30.50% | 70.8626 | 1.22E-15 | 67.38% | |
| ERR2017611_k103_38262_22 | 31.60% | 70.0922 | 1.23E-15 | 67.38% | |
| G88801_k105_91964_2 | 28.90% | 70.0922 | 1.23E-15 | 67.74% | |
| ERR2017627_k103_6263_13 | 29.60% | 70.0922 | 1.24E-15 | 70.61% | |
| G48806_k105_6646_5 | 32.30% | 70.0922 | 1.25E-15 | 69.18% | |
| ERR2017658_k103_22266_4 | 31.80% | 70.0922 | 1.25E-15 | 60.93% | |
| MSM79H6H_R_k105_62198_2 | 33.70% | 70.4774 | 1.27E-15 | 60.57% | |
| G48814_k105_22040_2 | 26.70% | 70.4774 | 1.27E-15 | 88.17% | |
| G89114_k105_73923_2 | 29.90% | 70.4774 | 1.29E-15 | 78.85% | |
| ERR2017708_k103_76473_2 | 30.00% | 70.0922 | 1.30E-15 | 60.93% | |
| G105108_k105_69257_2 | 28.90% | 70.0922 | 1.31E-15 | 68.46% | |
| G48820_k105_10194_59 | 31.40% | 70.0922 | 1.33E-15 | 70.61% | |
| ERR2017465_k103_80995_19 | 27.80% | 70.0922 | 1.33E-15 | 70.61% | |
| G48842_k105_53827_1 | 32.40% | 70.4774 | 1.35E-15 | 60.57% | |
| HSM7J4JH_R_k105_5288_2 | 30.10% | 70.0922 | 1.38E-15 | 69.18% | |
| G105000_k105_29605_5 | 30.70% | 70.0922 | 1.39E-15 | 67.38% | |
| ERR2017681_k103_83175_2 | 29.60% | 70.0922 | 1.39E-15 | 68.46% | |
| G48804_k105_7820_2 | 27.80% | 70.0922 | 1.40E-15 | 79.93% | |
| ERR2017630_k103_14364_7 | 29.70% | 70.0922 | 1.42E-15 | 67.38% | |
| G105007_k105_70208_3 | 28.40% | 70.0922 | 1.44E-15 | 68.46% | |
| PSMB4MBK_R_k105_12074_1 | 33.50% | 69.707 | 1.45E-15 | 60.93% | |
| G140936_k105_10836_2 | 29.20% | 70.0922 | 1.46E-15 | 67.38% | |
| G48842_k105_44309_2 | 27.20% | 70.0922 | 1.47E-15 | 89.25% | |
| HSMA33KS_R_k105_43252_2 | 28.60% | 70.0922 | 1.48E-15 | 68.46% | |
| ERR2017692_k103_55436_2 | 26.60% | 70.0922 | 1.48E-15 | 79.21% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017622_k103_106811_93 | 28.10% | 70.0922 | 1.54E−15 | 68.46% | |
| ERR2017581_k103_23882_1 | 30.10% | 70.4774 | 1.61E−15 | 66.31% | |
| G48783_k105_11351_31 | 29.60% | 69.707 | 1.61E−15 | 72.40% | |
| PSM7J17B_R_k105_3018_2 | 28.80% | 70.0922 | 1.69E−15 | 67.74% | |
| G105114_k105_85635_12 | 28.90% | 69.707 | 1.70E−15 | 66.67% | |
| G140794_k105_47545_1 | 28.40% | 69.707 | 1.73E−15 | 70.61% | |
| G89024_k105_70708_2 | 28.40% | 69.707 | 1.73E−15 | 69.53% | |
| ERR2017627_k103_4486_8 | 27.50% | 70.0922 | 1.73E−15 | 72.76% | |
| ERR2017640_k103_88107_4 | 31.90% | 69.3218 | 1.80E−15 | 66.67% | |
| CSM67UFZ_R_k105_15295_1 | 30.80% | 70.0922 | 1.81E−15 | 60.57% | |
| G36355_k105_53467_3 | 28.30% | 70.0922 | 1.82E−15 | 66.31% | |
| PSM7J15Q_R_k105_5086_2 | 26.60% | 69.707 | 1.82E−15 | 70.61% | |
| G72703_k105_73123_2 | 30.80% | 69.707 | 1.83E−15 | 69.18% | |
| CSM5MCZ3_R_k105_2687_1 | 29.40% | 69.707 | 1.83E−15 | 60.93% | |
| ERR2017682_k103_61144_2 | 28.80% | 69.707 | 1.86E−15 | 60.93% | |
| G140906_k105_41161_5 | 28.60% | 69.707 | 1.92E−15 | 65.95% | |
| G140835_k105_62319_2 | 27.90% | 69.707 | 1.92E−15 | 70.61% | |
| G48817_k105_56869_4 | 31.10% | 69.707 | 1.96E−15 | 67.38% | |
| G140014_k105_73358_5 | 30.30% | 70.0922 | 2.03E−15 | 68.46% | |
| G140954_k105_17301_3 | 29.10% | 70.0922 | 2.03E−15 | 70.97% | |
| ERR2017631_k103_67330_2 | 29.10% | 69.707 | 2.07E−15 | 68.46% | |
| G36370_k105_15464_32 | 27.30% | 69.707 | 2.14E−15 | 68.46% | |
| G104926_k105_4769_3 | 29.50% | 70.0922 | 2.16E−15 | 67.38% | |
| G72689_k105_14628_1 | 28.30% | 69.3218 | 2.18E−15 | 70.61% | |
| G140176_k105_10093_4 | 28.20% | 69.707 | 2.18E−15 | 68.46% | |
| G104817_k105_7956_3 | 27.50% | 69.3218 | 2.22E−15 | 67.38% | |
| HSMA33KS_R_k105_32797_1 | 31.40% | 69.707 | 2.24E−15 | 65.59% | |
| ERR2017675_k103_63644_2 | 29.40% | 69.3218 | 2.29E−15 | 68.46% | |
| G48791_k105_118790_2 | 29.50% | 69.707 | 2.32E−15 | 77.78% | |
| ERR2017576_k103_66017_3 | 27.90% | 69.707 | 2.33E−15 | 72.76% | |
| ERR2017631_k103_87781_12 | 32.40% | 69.3218 | 2.34E−15 | 66.67% | |
| G141820_k105_32546_5 | 26.30% | 69.3218 | 2.37E−15 | 70.61% | |
| G139971_k105_38132_9 | 28.10% | 69.3218 | 2.39E−15 | 60.93% | |
| G105115_k105_101906_2 | 32.30% | 68.1662 | 2.41E−15 | 46.24% | |
| G140164_k105_6796_5 | 31.40% | 69.3218 | 2.43E−15 | 66.67% | |
| G140898_k105_71565_3 | 28.30% | 69.3218 | 2.43E−15 | 68.10% | |
| G48839_k105_38564_78 | 29.20% | 69.3218 | 2.45E−15 | 68.46% | |
| ERR2017528_k103_38552_58 | 27.30% | 69.3218 | 2.45E−15 | 70.61% | |
| G140103_k105_62665_68 | 31.60% | 69.3218 | 2.46E−15 | 60.93% | |
| G48815_k105_38100_1 | 28.90% | 69.707 | 2.47E−15 | 67.74% | |
| G48798_k105_72677_20 | 27.20% | 69.707 | 2.48E−15 | 70.97% | |
| G140142_k105_28340_2 | 27.20% | 69.3218 | 2.55E−15 | 69.53% | |
| G140042_k105_13126_4 | 28.50% | 69.707 | 2.58E−15 | 76.70% | |
| ERR2017696_k103_644_25 | 29.10% | 69.3218 | 2.62E−15 | 71.33% | |
| G48807_k105_85359_4 | 26.80% | 69.3218 | 2.62E−15 | 70.61% | |
| G139960_k105_56547_1 | 30.50% | 69.3218 | 2.63E−15 | 74.19% | |
| G88933_k105_34966_2 | 29.30% | 69.3218 | 2.64E−15 | 68.46% | |
| G105079_k105_69894_2 | 30.60% | 69.707 | 2.66E−15 | 66.31% | |
| G72679_k105_23874_2 | 29.30% | 69.707 | 2.68E−15 | 68.46% | |
| ERR2017499_k103_15424_9 | 28.10% | 69.3218 | 2.68E−15 | 68.46% | |
| ERR2017591_k103_14557_13 | 28.00% | 69.3218 | 2.69E−15 | 66.31% | |
| G139975_k105_13036_15 | 28.30% | 69.707 | 2.74E−15 | 65.59% | |
| G104987_k105_47329_7 | 29.60% | 69.3218 | 2.80E−15 | 70.61% | |
| CSM67UCK_R_k105_4721_2 | 26.60% | 68.9366 | 2.80E−15 | 84.95% | |
| G104997_k105_6428_1 | 30.30% | 68.9366 | 2.95E−15 | 67.03% | |
| G36369_k105_7468_41 | 27.90% | 68.9366 | 3.00E−15 | 70.97% | |
| G104940_k105_62353_9 | 28.60% | 68.9366 | 3.08E−15 | 68.46% | |
| ERR2017605_k103_28752_5 | 30.70% | 68.9366 | 3.13E−15 | 68.46% | |
| G140038_k105_8824_4 | 29.20% | 69.707 | 3.19E−15 | 68.46% | |
| G104888_k105_56380_1 | 29.30% | 68.9366 | 3.20E−15 | 68.46% | |
| G89065_k105_45479_46 | 28.30% | 69.3218 | 3.27E−15 | 66.67% | |
| ERR2017507_k79_87156_3 | 29.90% | 68.9366 | 3.45E−15 | 68.82% | |
| CSM5MCUK_P_R_k105_2644_3 | 29.40% | 68.9366 | 3.45E−15 | 69.18% | |
| G140884_k105_31816_4 | 29.50% | 68.9366 | 3.46E−15 | 82.08% | |
| G104902_k105_32791_3 | 28.70% | 68.9366 | 3.54E−15 | 68.46% | |
| CSM67UAA_R_k105_3231_22 | 30.00% | 68.9366 | 3.57E−15 | 60.93% | |
| G48826_k105_19931_2 | 30.60% | 68.9366 | 3.59E−15 | 60.93% | |
| G88802_k105_7027_3 | 28.20% | 68.9366 | 3.59E−15 | 69.18% | |
| HSM67VHJ_R_k105_27562_2 | 30.40% | 68.9366 | 3.61E−15 | 68.10% | |
| ERR2017460_k93_22387_19 | 30.30% | 68.9366 | 3.68E−15 | 69.89% | |
| G48791_k105_197996_43 | 28.70% | 69.3218 | 3.77E−15 | 67.03% | |
| G72705_k105_69611_3 | 28.50% | 68.9366 | 3.84E−15 | 68.46% | |
| G140106_k105_9553_2 | 33.10% | 69.3218 | 3.87E−15 | 60.57% | |
| G88725_k105_49824_3 | 30.10% | 68.9366 | 3.87E−15 | 68.10% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G139955_k105_34945_86 | 30.50% | 68.9366 | 3.88E-15 | 70.25% | |
| ERR2017553_k103_17444_16 | 30.60% | 68.9366 | 3.89E-15 | 68.82% | |
| ERR2017522_k103_92373_2 | 30.30% | 68.5514 | 3.99E-15 | 68.46% | |
| ERR2017644_k103_53390_2 | 30.00% | 68.5514 | 3.99E-15 | 60.93% | |
| G48832_k105_22286_20 | 29.80% | 68.9366 | 4.07E-15 | 68.82% | |
| ERR2017716_k103_2675_95 | 30.00% | 68.5514 | 4.11E-15 | 69.89% | |
| ERR2017618_k103_99515_8 | 29.60% | 68.5514 | 4.17E-15 | 65.95% | |
| G48791_k105_75277_1 | 28.60% | 68.5514 | 4.21E-15 | 68.46% | |
| G88829_k105_87104_2 | 30.50% | 68.5514 | 4.24E-15 | 69.53% | |
| ERR2017682_k103_22302_10 | 28.90% | 68.5514 | 4.49E-15 | 69.53% | |
| G140940_k105_2539_6 | 26.50% | 68.9366 | 4.55E-15 | 80.29% | |
| ERR2017611_k103_4149_3 | 29.80% | 68.1662 | 4.67E-15 | 66.67% | |
| G141105_k105_63598_2 | 30.20% | 68.5514 | 4.68E-15 | 68.10% | |
| ERR2017551_k103_24348_2 | 29.90% | 68.9366 | 4.70E-15 | 68.46% | |
| MSM6J2MB_R_k105_1120_15 | 31.40% | 68.5514 | 4.74E-15 | 74.19% | |
| MSM79HF5_R_k105_44724_1 | 30.20% | 68.5514 | 4.74E-15 | 70.61% | |
| CSM79HOX_R_k105_6492_2 | 27.30% | 68.9366 | 4.94E-15 | 69.89% | |
| G36362_k105_67656_2 | 28.10% | 68.5514 | 5.04E-15 | 68.46% | |
| G36347_k105_17334_2 | 29.00% | 68.5514 | 5.07E-15 | 68.46% | |
| G48838_k105_75333_3 | 29.40% | 68.5514 | 5.13E-15 | 60.93% | |
| G72705_k105_59825_14 | 27.10% | 68.5514 | 5.21E-15 | 67.03% | |
| G48807_k105_78138_2 | 30.20% | 68.1662 | 5.30E-15 | 67.38% | |
| MSMAPC64_R_k105_30838_3 | 26.60% | 68.5514 | 5.52E-15 | 68.82% | |
| ERR2017705_k103_32472_164 | 29.40% | 68.1662 | 5.53E-15 | 71.33% | |
| ERR2017639_k103_64959_1 | 29.90% | 68.1662 | 5.54E-15 | 66.67% | |
| ERR2017604_k103_27454_1 | 28.40% | 68.5514 | 5.54E-15 | 68.46% | |
| G104890_k105_26539_4 | 29.40% | 68.1662 | 5.59E-15 | 60.93% | |
| ERR2017605_k103_112848_7 | 28.20% | 68.5514 | 5.79E-15 | 77.78% | |
| ERR2017650_k103_39143_6 | 30.60% | 68.5514 | 5.91E-15 | 68.46% | |
| ESM5ME9D_P_R_k105_8239_28 | 29.80% | 68.5514 | 5.91E-15 | 68.10% | |
| G105000_k105_71576_21 | 28.40% | 68.5514 | 6.10E-15 | 69.53% | |
| G72736_k105_15451_30 | 31.30% | 68.1662 | 6.27E-15 | 67.74% | |
| G48793_k105_55407_3 | 28.60% | 68.5514 | 6.35E-15 | 68.46% | |
| G141120_k105_23294_2 | 30.50% | 68.9366 | 6.36E-15 | 67.74% | |
| G72690_k105_43433_28 | 30.20% | 68.1662 | 6.48E-15 | 71.33% | |
| CSM79HN2_R_k105_79021_36 | 30.90% | 68.1662 | 6.58E-15 | 67.74% | |
| G72732_k105_65944_32 | 29.90% | 68.1662 | 6.63E-15 | 65.95% | |
| ERR2017599_k103_56131_22 | 29.10% | 68.1662 | 6.63E-15 | 70.97% | |
| ERR2017455_k93_45055_30 | 28.60% | 68.5514 | 6.88E-15 | 68.46% | |
| ERR2017593_k103_73404_2 | 31.00% | 68.1662 | 6.91E-15 | 68.46% | |
| G139967_k105_51614_3 | 26.60% | 68.1662 | 6.92E-15 | 68.46% | |
| G141131_k105_100422_5 | 28.00% | 68.1662 | 7.00E-15 | 67.74% | |
| ERR2017466_k103_20068_8 | 28.10% | 68.5514 | 7.10E-15 | 67.74% | |
| CSM79HPA_TR_R_k105_18257_2 | 29.60% | 68.1662 | 7.12E-15 | 68.10% | |
| ERR2017673_k103_2068_1 | 29.00% | 68.5514 | 7.18E-15 | 68.46% | |
| MSM6J2MB_R_k105_24448_19 | 29.10% | 68.1662 | 7.19E-15 | 68.82% | |
| G140969_k105_53042_4 | 30.50% | 68.1662 | 7.29E-15 | 69.53% | |
| G72694_k105_57124_26 | 29.10% | 68.9366 | 7.37E-15 | 68.46% | |
| ERR2017735_k103_48650_67 | 27.60% | 68.5514 | 7.38E-15 | 78.14% | |
| ERR2017669_k103_1204_14 | 25.50% | 68.1662 | 7.47E-15 | 69.53% | |
| G141016_k105_75496_1 | 27.80% | 68.1662 | 7.74E-15 | 68.46% | |
| G140088_k105_106610_2 | 31.50% | 67.781 | 7.76E-15 | 70.25% | |
| G141131_k105_35049_9 | 26.90% | 68.1662 | 8.29E-15 | 68.10% | |
| ERR2017482_k79_94078_13 | 28.40% | 67.781 | 8.63E-15 | 69.53% | |
| G72723_k105_42742_2 | 26.90% | 68.1662 | 8.63E-15 | 68.10% | |
| G72709_k105_49303_2 | 28.90% | 67.781 | 8.72E-15 | 69.18% | |
| G140872_k105_23093_4 | 26.40% | 67.781 | 8.74E-15 | 67.74% | |
| ERR2017689_k103_58946_1 | 25.80% | 67.781 | 8.75E-15 | 70.61% | |
| G140798_k105_91769_2 | 29.40% | 67.781 | 8.97E-15 | 71.68% | |
| G48815_k105_10150_2 | 27.70% | 68.1662 | 9.40E-15 | 69.53% | |
| G48812_k105_88827_4 | 31.10% | 67.781 | 9.85E-15 | 68.46% | |
| ERR2017700_k103_51831_9 | 27.90% | 67.781 | 9.91E-15 | 67.74% | |
| ERR2017613_k103_45054_1 | 30.00% | 67.781 | 1.01E-14 | 60.93% | |
| ERR2017617_k103_22796_2 | 31.50% | 67.3958 | 1.02E-14 | 68.10% | |
| G140964_k105_58498_9 | 27.00% | 67.781 | 1.03E-14 | 92.11% | |
| ERR2017456_k93_59670_3 | 30.50% | 67.781 | 1.11E-14 | 70.25% | |
| ERR2017556_k103_13482_18 | 32.50% | 67.3958 | 1.12E-14 | 70.25% | |
| ERR2017611_k103_55710_1 | 28.70% | 68.1662 | 1.14E-14 | 67.03% | |
| G140109_k105_79476_1 | 28.00% | 67.3958 | 1.17E-14 | 67.74% | |
| G140100_k105_63976_4 | 25.00% | 67.3958 | 1.19E-14 | 69.89% | |
| G104994_k105_63638_23 | 27.90% | 67.3958 | 1.20E-14 | 67.74% | |
| ERR2017638_k103_35116_2 | 29.40% | 67.0106 | 1.24E-14 | 75.27% | |
| G36366_k105_22517_35 | 26.70% | 67.3958 | 1.30E-14 | 69.53% | |
| ERR2017660_k103_41592_2 | 29.50% | 67.3958 | 1.31E-14 | 77.78% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48819_k105_13887_2 | 28.00% | 67.3958 | 1.32E−14 | 67.38% | |
| ERR2017673_k103_59386_3 | 30.50% | 67.0106 | 1.35E−14 | 66.67% | |
| ERR2017614_k103_125466_62 | 30.00% | 67.3958 | 1.35E−14 | 67.74% | |
| G140138_k105_50244_2 | 28.80% | 67.3958 | 1.36E−14 | 69.53% | |
| G104950_k105_3862_20 | 28.20% | 67.3958 | 1.37E−14 | 67.03% | |
| G105108_k105_50921_2 | 28.30% | 66.6254 | 1.38E−14 | 66.67% | |
| PSM7J14L_R_k105_704_4 | 28.90% | 67.3958 | 1.43E−14 | 68.82% | |
| ERR2017628_k103_39887_7 | 28.00% | 67.3958 | 1.43E−14 | 66.31% | |
| G89019_k105_14772_6 | 32.10% | 67.781 | 1.44E−14 | 67.03% | |
| G36387_k105_8183_4 | 28.60% | 67.781 | 1.44E−14 | 67.74% | |
| G140185_k105_61550_6 | 30.50% | 67.0106 | 1.48E−14 | 70.97% | |
| G36361_k105_13715_2 | 29.90% | 67.0106 | 1.48E−14 | 66.67% | |
| MSM5LLEP_R_k105_12272_24 | 26.70% | 67.3958 | 1.48E−14 | 69.53% | |
| G140137_k105_61767_2 | 26.90% | 67.0106 | 1.55E−14 | 67.74% | |
| ERR2017519_k103_41937_3 | 30.50% | 67.0106 | 1.63E−14 | 70.25% | |
| CSM9X222_R_k105_47383_2 | 27.50% | 67.0106 | 1.63E−14 | 68.82% | |
| ERR2017613_k103_25741_2 | 31.40% | 67.0106 | 1.69E−14 | 68.46% | |
| G72705_k105_28418_3 | 27.30% | 67.0106 | 1.69E−14 | 79.57% | |
| CSM79HNE_R_k105_6917_14 | 26.80% | 67.0106 | 1.70E−14 | 67.74% | |
| CSM5MCYS_R_k105_36307_2 | 28.10% | 67.0106 | 1.78E−14 | 68.46% | |
| G48802_k105_52165_1 | 29.60% | 67.0106 | 1.82E−14 | 68.46% | |
| G72711_k105_5691_12 | 29.20% | 67.0106 | 1.84E−14 | 74.19% | |
| G141006_k105_82582_13 | 28.60% | 67.3958 | 1.85E−14 | 68.46% | |
| G89136_k105_16579_1 | 28.80% | 67.0106 | 1.89E−14 | 69.53% | |
| ERR2017519_k103_66316_3 | 24.40% | 67.781 | 1.89E−14 | 92.83% | |
| ERR2017438_k93_36824_5 | 29.00% | 66.6254 | 1.99E−14 | 68.82% | |
| ERR2017555_k103_48286_16 | 29.40% | 67.3958 | 2.05E−14 | 68.46% | |
| G88838_k105_67115_10 | 28.00% | 66.6254 | 2.09E−14 | 67.74% | |
| ERR2017605_k103_21352_6 | 27.60% | 67.0106 | 2.09E−14 | 67.38% | |
| ERR2017592_k103_5824_6 | 27.50% | 67.0106 | 2.09E−14 | 67.74% | |
| ERR2017713_k103_86273_10 | 30.80% | 66.6254 | 2.15E−14 | 68.46% | |
| G105094_k105_35102_3 | 28.20% | 66.6254 | 2.16E−14 | 68.46% | |
| G89065_k105_44762_8 | 27.10% | 66.6254 | 2.19E−14 | 70.97% | |
| G140979_k105_3526_3 | 30.10% | 66.6254 | 2.22E−14 | 47.31% | |
| G104913_k105_98027_2 | 29.10% | 66.2402 | 2.24E−14 | 61.65% | |
| MSM9VZOS_R_k105_8640_5 | 29.40% | 66.6254 | 2.31E−14 | 68.82% | |
| ERR2017446_k93_11340_6 | 28.60% | 66.6254 | 2.31E−14 | 68.82% | |
| G89268_k105_36439_3 | 28.40% | 66.6254 | 2.32E−14 | 67.38% | |
| G104980_k105_42184_2 | 27.70% | 67.3958 | 2.32E−14 | 78.85% | |
| G139996_k105_1146_3 | 26.40% | 66.6254 | 2.34E−14 | 67.74% | |
| ERR2017688_k103_105652_4 | 25.80% | 67.0106 | 2.34E−14 | 67.74% | |
| ERR2017608_k103_2280_29 | 28.80% | 66.6254 | 2.36E−14 | 74.91% | |
| HSM67VFX_P_R_k105_27767_1 | 26.90% | 67.0106 | 2.36E−14 | 68.82% | |
| G105000_k105_18211_2 | 28.40% | 66.6254 | 2.37E−14 | 69.18% | |
| G48807_k105_94506_2 | 30.80% | 66.6254 | 2.41E−14 | 69.18% | |
| ERR2017568_k103_15909_14 | 28.30% | 66.6254 | 2.41E−14 | 68.46% | |
| CSM7KOON_R_k105_20482_2 | 27.80% | 66.6254 | 2.41E−14 | 68.46% | |
| G88744_k105_24353_3 | 32.10% | 66.6254 | 2.41E−14 | 68.82% | |
| ERR2017637_k103_4812_2 | 28.60% | 66.6254 | 2.51E−14 | 68.46% | |
| ERR2017693_k103_28111_10 | 27.60% | 66.6254 | 2.51E−14 | 60.93% | |
| ERR2017569_k103_24093_16 | 29.80% | 66.6254 | 2.56E−14 | 68.46% | |
| ERR2017541_k103_4721_8 | 33.50% | 66.6254 | 2.61E−14 | 60.57% | |
| ERR2017735_k103_63910_58 | 29.50% | 67.0106 | 2.70E−14 | 65.23% | |
| ERR2017589_k103_23068_7 | 28.20% | 66.2402 | 2.73E−14 | 60.93% | |
| G140088_k105_77842_12 | 28.00% | 66.6254 | 2.78E−14 | 68.10% | |
| G89089_k105_25643_13 | 27.70% | 66.6254 | 2.80E−14 | 79.57% | |
| ERR2017611_k103_21696_6 | 29.10% | 66.2402 | 2.91E−14 | 68.82% | |
| ERR2017674_k103_16236_43 | 27.90% | 67.0106 | 2.91E−14 | 72.76% | |
| G140042_k105_46414_12 | 28.70% | 66.2402 | 3.16E−14 | 68.46% | |
| ERR2017565_k103_10031_68 | 27.80% | 66.2402 | 3.29E−14 | 68.46% | |
| PSM7J17B_R_k105_1479_2 | 29.70% | 66.6254 | 3.30E−14 | 68.10% | |
| ERR2017688_k103_30300_14 | 30.40% | 66.2402 | 3.32E−14 | 67.74% | |
| G105014_k105_14111_16 | 27.70% | 66.2402 | 3.32E−14 | 68.46% | |
| G140946_k105_81243_2 | 30.30% | 66.2402 | 3.41E−14 | 66.31% | |
| G88838_k105_56902_7 | 27.50% | 66.2402 | 3.49E−14 | 67.74% | |
| G72701_k105_48495_35 | 30.30% | 66.2402 | 3.52E−14 | 69.89% | |
| G89182_k105_96582_12 | 30.10% | 66.2402 | 3.54E−14 | 68.82% | |
| G140022_k105_33871_24 | 26.40% | 66.2402 | 3.63E−14 | 67.74% | |
| ERR2017667_k103_16253_3 | 31.80% | 65.855 | 3.69E−14 | 68.82% | |
| G140127_k105_9689_199 | 27.10% | 66.2402 | 3.82E−14 | 67.74% | |
| MSM5LLE3_P_R_k105_35315_1 | 28.90% | 66.6254 | 3.83E−14 | 68.46% | |
| ERR2017653_k103_22656_6 | 28.60% | 65.855 | 3.90E−14 | 68.82% | |
| G140127_k105_18896_4 | 26.30% | 66.2402 | 3.90E−14 | 67.74% | |
| ERR2017631_k103_66813_3 | 29.90% | 65.855 | 3.92E−14 | 66.67% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017652_k103_5201_2 | 28.80% | 65.855 | 3.94E−14 | 60.93% | |
| ERR2017675_k103_25515_3 | 29.90% | 65.855 | 4.04E−14 | 66.67% | |
| G88755_k105_74875_2 | 28.30% | 65.855 | 4.06E−14 | 68.46% | |
| G104898_k105_28751_2 | 28.40% | 65.855 | 4.31E−14 | 70.97% | |
| G105053_k105_13898_1 | 26.10% | 66.2402 | 4.32E−14 | 66.31% | |
| ERR2017543_k103_26347_9 | 28.90% | 65.855 | 4.36E−14 | 67.74% | |
| ERR2017559_k103_39112_104 | 34.70% | 65.855 | 4.51E−14 | 60.93% | |
| G48784_k105_9944_8 | 27.90% | 65.855 | 4.52E−14 | 67.74% | |
| G140847_k105_40774_49 | 26.80% | 65.855 | 4.57E−14 | 67.74% | |
| G48790_k105_15366_16 | 26.00% | 66.2402 | 4.70E−14 | 90.68% | |
| ERR2017704_k103_50742_18 | 27.60% | 65.855 | 4.81E−14 | 68.46% | |
| G104883_k105_8912_2 | 27.80% | 65.855 | 4.86E−14 | 68.46% | |
| G140114_k105_14395_1 | 29.50% | 65.4698 | 4.95E−14 | 68.46% | |
| G141126_k105_22068_1 | 30.10% | 65.855 | 4.96E−14 | 67.74% | |
| CSM79HHM_R_k105_472_19 | 28.30% | 65.855 | 5.16E−14 | 68.46% | |
| G140965_k105_53271_3 | 29.70% | 65.855 | 5.27E−14 | 65.95% | |
| G141817_k105_62304_2 | 30.30% | 65.4698 | 5.32E−14 | 46.95% | |
| ERR2017636_k103_10295_101 | 28.00% | 65.4698 | 5.34E−14 | 70.25% | |
| G140079_k105_4434_2 | 28.60% | 65.855 | 5.41E−14 | 74.55% | |
| G48817_k105_98126_1 | 27.30% | 65.4698 | 5.51E−14 | 70.25% | |
| ERR2017450_k93_16033_43 | 33.90% | 65.4698 | 5.57E−14 | 60.93% | |
| G36392_k105_10697_2 | 28.10% | 65.855 | 5.65E−14 | 68.46% | |
| G88903_k105_18037_3 | 30.40% | 65.4698 | 5.71E−14 | 68.10% | |
| G89256_k105_54395_10 | 29.40% | 65.4698 | 5.80E−14 | 60.93% | |
| G140946_k105_95626_8 | 30.00% | 65.855 | 5.89E−14 | 76.34% | |
| G36350_k105_10034_25 | 26.70% | 65.4698 | 6.34E−14 | 68.82% | |
| G141071_k105_26898_3 | 28.20% | 65.4698 | 6.35E−14 | 77.78% | |
| ERR2017659_k103_28782_2 | 31.90% | 65.855 | 6.41E−14 | 70.25% | |
| G72737_k105_22406_2 | 30.90% | 65.4698 | 6.46E−14 | 68.46% | |
| G140075_k105_10623_8 | 29.30% | 65.4698 | 6.46E−14 | 67.74% | |
| ERR2017713_k103_70887_3 | 28.90% | 65.0846 | 6.47E−14 | 75.27% | |
| G89055_k105_26750_8 | 31.60% | 65.0846 | 6.50E−14 | 64.16% | |
| ERR2017631_k103_80875_6 | 29.40% | 65.0846 | 6.66E−14 | 66.67% | |
| ERR2017577_k103_40458_5 | 27.10% | 65.4698 | 6.71E−14 | 68.46% | |
| ERR2017651_k103_46482_137 | 28.50% | 65.4698 | 7.05E−14 | 68.10% | |
| G141040_k105_86346_4 | 26.80% | 65.0846 | 7.31E−14 | 67.74% | |
| G140786_k105_9825_2 | 29.90% | 65.4698 | 7.40E−14 | 70.25% | |
| G48838_k105_85766_11 | 32.10% | 65.0846 | 7.53E−14 | 46.59% | |
| ERR2017639_k103_29376_7 | 27.10% | 65.4698 | 7.70E−14 | 67.74% | |
| G48791_k105_121636_5 | 30.20% | 65.4698 | 7.91E−14 | 75.99% | |
| ERR2017576_k103_81965_3 | 28.90% | 65.0846 | 8.22E−14 | 75.27% | |
| G48812_k105_43678_116 | 28.90% | 65.4698 | 8.24E−14 | 74.55% | |
| G105028_k105_17685_16 | 27.80% | 65.0846 | 8.25E−14 | 68.46% | |
| G104872_k105_46453_1 | 29.70% | 65.4698 | 8.35E−14 | 67.74% | |
| G48836_k105_7323_22 | 26.40% | 65.0846 | 8.38E−14 | 62.72% | |
| G104895_k105_11498_1 | 26.30% | 65.4698 | 8.42E−14 | 67.74% | |
| G36363_k105_53538_29 | 26.30% | 65.4698 | 8.48E−14 | 67.74% | |
| ERR2017638_k103_24129_2 | 26.50% | 65.0846 | 8.51E−14 | 68.82% | |
| G141819_k105_44854_4 | 30.50% | 65.0846 | 8.57E−14 | 67.38% | |
| G140796_k105_31673_3 | 27.30% | 65.0846 | 8.68E−14 | 68.46% | |
| ERR2017678_k103_147_33 | 25.80% | 65.4698 | 8.93E−14 | 67.74% | |
| CSM79HGZ_R_k105_17914_6 | 27.50% | 65.0846 | 9.12E−14 | 67.74% | |
| ERR2017659_k103_92981_6 | 32.50% | 65.0846 | 9.46E−14 | 65.59% | |
| ERR2017681_k103_28529_33 | 26.90% | 65.0846 | 9.47E−14 | 70.25% | |
| G140862_k105_20065_4 | 29.10% | 65.0846 | 9.49E−14 | 70.25% | |
| ERR2017536_k103_10069_2 | 28.50% | 65.0846 | 9.66E−14 | 67.74% | |
| G140775_k105_88713_2 | 32.70% | 65.0846 | 9.82E−14 | 68.46% | |
| ERR2017637_k103_26213_3 | 31.90% | 65.0846 | 9.84E−14 | 56.99% | |
| ERR2017653_k103_28720_3 | 28.90% | 64.6994 | 9.85E−14 | 75.27% | |
| G139998_k105_34320_1 | 26.70% | 65.0846 | 1.02E−13 | 70.61% | |
| G104969_k105_61463_1 | 33.00% | 64.6994 | 1.03E−13 | 60.93% | |
| ERR2017461_k103_7903_2 | 26.00% | 65.0846 | 1.07E−13 | 70.61% | |
| ERR2017692_k103_109873_2 | 30.10% | 65.0846 | 1.10E−13 | 59.14% | |
| G48817_k105_2987_2 | 29.60% | 64.6994 | 1.14E−13 | 69.18% | |
| G72683_k105_9408_11 | 29.10% | 65.0846 | 1.22E−13 | 67.38% | |
| CSM79HHM_R_k105_36088_19 | 28.50% | 64.6994 | 1.24E−13 | 67.74% | |
| G140078_k105_32068_1 | 27.20% | 64.6994 | 1.26E−13 | 69.53% | |
| G48795_k105_91713_4 | 29.90% | 64.6994 | 1.28E−13 | 68.10% | |
| G72710_k105_18110_6 | 28.50% | 64.6994 | 1.28E−13 | 68.46% | |
| G88934_k105_4632_1 | 30.40% | 65.0846 | 1.29E−13 | 67.38% | |
| ERR2017617_k103_31111_16 | 28.90% | 64.6994 | 1.29E−13 | 69.18% | |
| G140849_k105_11260_1 | 27.60% | 64.6994 | 1.30E−13 | 75.99% | |
| G48792_k105_56706_8 | 34.40% | 64.3142 | 1.33E−13 | 50.18% | |
| ERR2017643_k103_21045_3 | 29.90% | 64.3142 | 1.36E−13 | 66.67% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G140880_k105_14667_6 | 30.80% | 64.6994 | 1.44E−13 | 68.46% | |
| G141051_k105_53943_5 | 29.70% | 64.3142 | 1.50E−13 | 67.74% | |
| ERR2017577_k103_95564_183 | 28.40% | 64.6994 | 1.50E−13 | 70.97% | |
| G104829_k105_19574_4 | 24.50% | 64.6994 | 1.50E−13 | 67.03% | |
| G72716_k105_58865_1 | 27.00% | 64.3142 | 1.52E−13 | 70.25% | |
| G48790_k105_79570_10 | 26.40% | 64.3142 | 1.52E−13 | 67.74% | |
| G140117_k105_32740_229 | 29.50% | 64.3142 | 1.55E−13 | 67.74% | |
| G48841_k105_34449_26 | 26.80% | 64.6994 | 1.56E−13 | 67.74% | |
| G141086_k105_13808_5 | 28.00% | 64.3142 | 1.58E−13 | 62.72% | |
| ERR2017620_k103_12629_42 | 29.90% | 63.929 | 1.59E−13 | 66.67% | |
| G48792_k105_104872_5 | 29.60% | 64.6994 | 1.65E−13 | 60.57% | |
| G48806_k105_24850_2 | 30.40% | 63.929 | 1.66E−13 | 69.53% | |
| MSM79HAL_R_k105_20354_2 | 27.60% | 64.3142 | 1.72E−13 | 68.46% | |
| G72703_k105_4320_10 | 31.30% | 64.3142 | 1.73E−13 | 65.95% | |
| ERR2017586_k103_14953_3 | 28.40% | 64.3142 | 1.73E−13 | 70.97% | |
| ERR2017662_k103_81113_1 | 28.40% | 63.929 | 1.74E−13 | 75.27% | |
| MSMAPC5Z_R_k105_34057_2 | 29.60% | 64.6994 | 1.78E−13 | 68.46% | |
| MSM9VZHZ_R_k105_22248_2 | 24.40% | 64.6994 | 1.83E−13 | 68.82% | |
| G72731_k105_38163_7 | 30.10% | 64.3142 | 1.85E−13 | 68.82% | |
| G48790_k105_1358_34 | 26.60% | 64.3142 | 1.85E−13 | 68.46% | |
| ERR2017699_k103_20019_15 | 28.20% | 64.3142 | 1.87E−13 | 70.61% | |
| G48807_k105_7616_4 | 31.50% | 64.3142 | 1.90E−13 | 50.90% | |
| MSM9VZF7_R_k105_23695_1 | 30.10% | 63.929 | 1.92E−13 | 68.46% | |
| G88951_k105_394_1 | 27.40% | 64.3142 | 1.92E−13 | 67.38% | |
| ERR2017680_k103_8033_36 | 31.40% | 62.7734 | 1.99E−13 | 59.14% | |
| ERR2017606_k103_18959_5 | 30.60% | 65.855 | 1.99E−13 | 65.59% | |
| G140783_k105_11631_1 | 26.20% | 63.929 | 1.99E−13 | 67.74% | |
| G140202_k105_54624_7 | 26.00% | 64.3142 | 2.11E−13 | 68.10% | |
| ERR2017618_k103_15195_6 | 29.40% | 63.929 | 2.13E−13 | 66.67% | |
| G48820_k105_6957_2 | 30.40% | 63.929 | 2.22E−13 | 68.10% | |
| G36370_k105_6682_2 | 28.90% | 63.929 | 2.33E−13 | 67.74% | |
| G140189_k105_25030_2 | 29.80% | 63.929 | 2.40E−13 | 70.25% | |
| ERR2017725_k103_15488_3 | 29.50% | 63.929 | 2.57E−13 | 67.74% | |
| ERR2017662_k103_110809_1 | 29.40% | 63.5438 | 2.57E−13 | 66.67% | |
| G89166_k105_51839_1 | 24.40% | 63.929 | 2.61E−13 | 68.82% | |
| ESM718V8_R_k105_13178_2 | 27.30% | 63.929 | 2.68E−13 | 68.46% | |
| ERR2017631_k103_380_1 | 28.90% | 63.5438 | 2.76E−13 | 66.67% | |
| G104823_k105_64038_2 | 26.70% | 63.929 | 2.79E−13 | 66.31% | |
| ERR2017678_k103_13064_34 | 27.50% | 64.3142 | 2.96E−13 | 72.40% | |
| G104923_k105_10415_2 | 32.50% | 63.5438 | 3.00E−13 | 68.46% | |
| G36389_k105_24519_21 | 27.50% | 63.5438 | 3.05E−13 | 67.38% | |
| ERR2017598_k103_141262_71 | 29.40% | 63.1586 | 3.08E−13 | 66.67% | |
| HSM5MD57_P_R_k105_32686_3 | 28.90% | 63.5438 | 3.11E−13 | 67.74% | |
| G48832_k105_34431_20 | 26.20% | 63.5438 | 3.15E−13 | 69.53% | |
| G140911_k105_458_16 | 28.60% | 63.5438 | 3.23E−13 | 70.97% | |
| G36374_k105_21299_5 | 26.60% | 63.5438 | 3.26E−13 | 70.61% | |
| G48839_k105_14226_103 | 26.10% | 63.5438 | 3.26E−13 | 70.61% | |
| ERR2017458_k93_57576_38 | 25.80% | 63.929 | 3.26E−13 | 67.74% | |
| G48784_k105_52712_3 | 26.40% | 63.929 | 3.33E−13 | 72.40% | |
| G140853_k105_22916_3 | 29.70% | 63.1586 | 3.37E−13 | 75.27% | |
| G140819_k105_73793_3 | 27.80% | 63.5438 | 3.38E−13 | 68.46% | |
| HSM6XRQB_P_R_k105_41921_5 | 28.80% | 63.5438 | 3.53E−13 | 68.10% | |
| ERR2017535_k103_25292_2 | 25.30% | 63.5438 | 3.54E−13 | 67.74% | |
| G140002_k105_45903_3 | 28.80% | 63.5438 | 3.59E−13 | 60.93% | |
| ERR2017614_k103_14363_1 | 29.40% | 63.1586 | 3.61E−13 | 66.67% | |
| G141012_k105_35467_1 | 29.30% | 63.5438 | 3.66E−13 | 75.99% | |
| ESM5MEB7_R_k105_42582_2 | 27.10% | 63.5438 | 3.68E−13 | 62.01% | |
| G88975_k105_41619_1 | 26.30% | 63.5438 | 3.75E−13 | 67.74% | |
| G72679_k105_14370_2 | 28.60% | 63.5438 | 3.82E−13 | 68.46% | |
| G105040_k105_71789_8 | 26.00% | 63.1586 | 3.83E−13 | 70.97% | |
| G88707_k105_59840_1 | 26.10% | 63.1586 | 4.07E−13 | 68.46% | |
| G48839_k105_64127_10 | 25.30% | 63.5438 | 4.11E−13 | 67.74% | |
| G139962_k105_48290_10 | 29.50% | 63.1586 | 4.15E−13 | 67.74% | |
| G140027_k105_19655_2 | 27.00% | 63.5438 | 4.15E−13 | 63.80% | |
| G48823_k105_101998_3 | 28.20% | 63.5438 | 4.44E−13 | 63.80% | |
| G48791_k105_10965_35 | 28.00% | 63.1586 | 4.48E−13 | 67.74% | |
| G140186_k105_34309_1 | 26.30% | 63.5438 | 4.62E−13 | 67.74% | |
| G141007_k105_3760_2 | 29.80% | 62.7734 | 4.65E−13 | 67.03% | |
| G36356_k105_13466_28 | 28.90% | 63.1586 | 4.72E−13 | 62.01% | |
| G141125_k105_66799_2 | 27.60% | 63.1586 | 4.82E−13 | 68.46% | |
| ERR2017618_k103_3529_14 | 26.90% | 63.1586 | 4.84E−13 | 66.31% | |
| ERR2017726_k103_22993_21 | 28.40% | 62.7734 | 4.87E−13 | 75.27% | |
| ERR2017531_k103_7122_8 | 26.60% | 63.1586 | 4.90E−13 | 67.74% | |
| G139982_k105_54160_2 | 29.00% | 63.5438 | 4.93E−13 | 69.53% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G105008_k105_5991_3 | 28.70% | 63.1586 | 4.93E-13 | 70.25% | |
| ERR2017549_k103_76007_8 | 31.70% | 61.2326 | 5.00E-13 | 44.09% | |
| G36370_k105_8751_39 | 27.40% | 62.7734 | 5.05E-13 | 69.18% | |
| G48812_k105_9194_1 | 25.80% | 63.1586 | 5.07E-13 | 67.74% | |
| G105065_k105_8237_9 | 30.00% | 62.7734 | 5.26E-13 | 70.61% | |
| G105114_k105_10366_5 | 29.20% | 62.7734 | 5.45E-13 | 67.38% | |
| G104998_k105_7853_4 | 25.30% | 63.1586 | 5.48E-13 | 67.74% | |
| CSM5MCXB_P_R_k105_12902_1 | 27.80% | 63.5438 | 5.51E-13 | 67.74% | |
| CSM79HNI_R_k105_11987_6 | 28.30% | 62.7734 | 5.69E-13 | 70.61% | |
| MSM79H5E_R_k105_58710_2 | 26.30% | 63.1586 | 5.82E-13 | 67.74% | |
| ERR2017662_k103_81106_1 | 28.40% | 62.3882 | 5.94E-13 | 75.27% | |
| ERR2017674_k103_7838_14 | 28.00% | 62.3882 | 6.06E-13 | 75.27% | |
| ERR2017574_k103_35057_3 | 26.50% | 62.7734 | 6.34E-13 | 69.18% | |
| ERR2017556_k103_84623_2 | 28.60% | 62.7734 | 6.39E-13 | 68.46% | |
| ERR2017632_k103_98480_2 | 25.80% | 62.7734 | 6.45E-13 | 67.74% | |
| ERR2017574_k103_62596_22 | 34.10% | 62.3882 | 6.75E-13 | 60.93% | |
| ERR2017637_k103_21547_28 | 31.90% | 62.7734 | 6.89E-13 | 70.25% | |
| ERR2017467_k103_104261_6 | 29.60% | 62.7734 | 6.99E-13 | 68.46% | |
| G48820_k105_8920_170 | 28.90% | 62.7734 | 7.09E-13 | 67.74% | |
| G104860_k105_1317_1 | 29.00% | 62.7734 | 7.18E-13 | 71.33% | |
| ERR2017611_k103_90975_57 | 26.30% | 62.7734 | 7.46E-13 | 66.31% | |
| ERR2017674_k103_6521_19 | 28.80% | 62.7734 | 7.54E-13 | 68.10% | |
| G141011_k105_467_27 | 27.70% | 63.1586 | 7.66E-13 | 75.63% | |
| ERR2017441_k93_27946_2 | 28.60% | 62.003 | 7.67E-13 | 75.63% | |
| G140198_k105_262_3 | 25.20% | 62.3882 | 7.95E-13 | 90.68% | |
| PSM7J14L_R_k105_3955_127 | 27.80% | 62.3882 | 8.06E-13 | 68.82% | |
| ERR2017686_k103_43877_2 | 28.20% | 62.3882 | 8.25E-13 | 74.19% | |
| G36392_k105_20560_5 | 28.50% | 62.3882 | 8.26E-13 | 68.46% | |
| ERR2017686_k103_101137_91 | 28.40% | 62.3882 | 8.37E-13 | 67.74% | |
| ERR2017624_k103_39429_3 | 29.40% | 62.003 | 8.41E-13 | 66.67% | |
| ERR2017568_k103_24746_3 | 28.30% | 62.3882 | 8.48E-13 | 66.67% | |
| G141083_k105_30428_2 | 30.00% | 62.003 | 8.56E-13 | 70.61% | |
| G72690_k105_124636_5 | 25.80% | 62.3882 | 8.56E-13 | 67.74% | |
| G72697_k105_51499_3 | 26.60% | 62.3882 | 8.65E-13 | 68.46% | |
| ERR2017581_k103_89684_63 | 26.40% | 62.3882 | 8.73E-13 | 67.74% | |
| G140884_k105_11480_2 | 26.30% | 62.3882 | 8.99E-13 | 68.46% | |
| G48821_k105_15594_4 | 25.10% | 62.7734 | 9.93E-13 | 69.53% | |
| G48812_k105_101265_1 | 29.10% | 62.3882 | 1.02E-12 | 58.78% | |
| ERR2017686_k103_5648_20 | 27.50% | 62.7734 | 1.02E-12 | 67.38% | |
| G140010_k105_57289_12 | 26.60% | 62.3882 | 1.02E-12 | 67.74% | |
| G140867_k105_3347_4 | 26.90% | 62.003 | 1.08E-12 | 66.67% | |
| HSM5MD53_R_k105_11106_11 | 31.10% | 62.003 | 1.11E-12 | 67.74% | |
| G141071_k105_30476_1 | 30.50% | 62.3882 | 1.11E-12 | 67.74% | |
| ERR2017555_k103_75266_3 | 28.80% | 62.003 | 1.11E-12 | 60.93% | |
| G104893_k105_24944_2 | 27.80% | 62.003 | 1.11E-12 | 67.74% | |
| G48792_k105_85120_7 | 26.30% | 62.3882 | 1.11E-12 | 67.74% | |
| HSM5MD53_R_k105_19189_16 | 27.60% | 62.7734 | 1.12E-12 | 60.22% | |
| G141037_k105_61614_10 | 26.30% | 62.003 | 1.12E-12 | 67.74% | |
| G88899_k105_40262_4 | 28.60% | 62.003 | 1.13E-12 | 68.46% | |
| G89065_k105_134985_11 | 26.90% | 62.3882 | 1.15E-12 | 74.91% | |
| G88829_k105_5139_1 | 23.20% | 62.003 | 1.17E-12 | 69.18% | |
| G140926_k105_10107_1 | 29.00% | 62.3882 | 1.19E-12 | 69.53% | |
| G36347_k105_11649_2 | 29.10% | 62.003 | 1.22E-12 | 66.67% | |
| G48777_k105_54242_12 | 32.70% | 61.6178 | 1.25E-12 | 55.56% | |
| ERR2017570_k103_17133_10 | 29.20% | 62.003 | 1.25E-12 | 68.46% | |
| G89065_k105_33512_7 | 27.90% | 62.003 | 1.25E-12 | 71.68% | |
| ERR2017462_k103_45511_1 | 27.80% | 62.3882 | 1.25E-12 | 66.67% | |
| G140130_k105_47779_27 | 26.40% | 62.003 | 1.26E-12 | 67.74% | |
| ERR2017622_k103_105984_114 | 26.30% | 62.003 | 1.28E-12 | 67.74% | |
| G105099_k105_23001_18 | 27.10% | 62.003 | 1.29E-12 | 67.74% | |
| G140864_k105_25432_3 | 28.60% | 62.003 | 1.30E-12 | 68.46% | |
| G139953_k105_17905_48 | 27.80% | 62.003 | 1.31E-12 | 67.74% | |
| G88780_k105_30102_8 | 29.60% | 62.7734 | 1.33E-12 | 69.18% | |
| ERR2017491_k103_92668_8 | 28.10% | 61.6178 | 1.34E-12 | 68.10% | |
| G140758_k105_38294_2 | 24.30% | 62.003 | 1.38E-12 | 87.46% | |
| MSM9VZLN_R_k105_76387_12 | 28.00% | 62.003 | 1.43E-12 | 75.99% | |
| G140795_k105_25218_3 | 29.20% | 61.6178 | 1.46E-12 | 67.74% | |
| MSM79H94_P_R_k105_23487_3 | 26.60% | 61.6178 | 1.47E-12 | 68.46% | |
| CSM7KOLK_R_k105_38324_1 | 25.80% | 62.003 | 1.48E-12 | 67.74% | |
| G104945_k105_62722_14 | 35.30% | 61.2326 | 1.49E-12 | 41.58% | |
| ERR2017529_k103_2513_47 | 25.80% | 62.003 | 1.50E-12 | 67.74% | |
| ERR2017545_k103_66522_9 | 29.30% | 61.6178 | 1.53E-12 | 68.10% | |
| G140964_k105_18777_11 | 27.60% | 61.6178 | 1.58E-12 | 70.97% | |
| ERR2017614_k103_31226_117 | 27.60% | 61.6178 | 1.58E-12 | 71.68% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017627_k103_5191_9 | 30.50% | 61.6178 | 1.59E-12 | 67.74% | |
| ERR2017641_k103_3944_2 | 28.60% | 61.2326 | 1.59E-12 | 70.61% | |
| G48817_k105_109935_2 | 28.40% | 62.3882 | 1.59E-12 | 65.95% | |
| CSM5MCX3_R_k105_2746_1 | 25.80% | 61.6178 | 1.64E-12 | 67.74% | |
| G140884_k105_50467_11 | 26.60% | 61.6178 | 1.74E-12 | 68.46% | |
| G141001_k105_25796_34 | 28.90% | 61.6178 | 1.78E-12 | 70.25% | |
| G140805_k105_73579_1 | 28.60% | 61.6178 | 1.78E-12 | 68.46% | |
| G140176_k105_5182_9 | 27.30% | 62.003 | 1.81E-12 | 65.59% | |
| ERR2017540_k103_68543_4 | 28.10% | 61.6178 | 1.84E-12 | 68.46% | |
| G105040_k105_42142_63 | 28.90% | 61.6178 | 1.89E-12 | 69.18% | |
| G48780_k105_14908_2 | 24.70% | 61.6178 | 1.90E-12 | 67.74% | |
| G104834_k105_41478_1 | 28.00% | 61.2326 | 1.93E-12 | 75.27% | |
| MSM5LLHGP_R_k105_2772_35 | 26.10% | 61.2326 | 2.04E-12 | 68.46% | |
| G140012_k105_92516_3 | 26.30% | 61.6178 | 2.09E-12 | 67.74% | |
| G72708_k105_9332_30 | 31.50% | 62.003 | 2.12E-12 | 62.01% | |
| ERR2017643_k103_29169_2 | 26.40% | 61.6178 | 2.16E-12 | 72.40% | |
| G48821_k105_1104_134 | 25.80% | 61.6178 | 2.18E-12 | 67.74% | |
| G140162_k105_65352_3 | 27.80% | 61.2326 | 2.20E-12 | 65.59% | |
| ERR2017684_k103_39976_1 | 25.30% | 61.6178 | 2.20E-12 | 67.74% | |
| G104973_k105_14346_2 | 25.80% | 61.2326 | 2.33E-12 | 67.74% | |
| G48822_k105_6243_3 | 28.00% | 61.6178 | 2.37E-12 | 66.31% | |
| ERR2017674_k103_16808_6 | 27.80% | 61.2326 | 2.37E-12 | 67.74% | |
| G36361_k105_7007_9 | 28.40% | 60.8474 | 2.38E-12 | 75.27% | |
| G140027_k105_44962_7 | 26.20% | 61.2326 | 2.38E-12 | 69.53% | |
| G48784_k105_134757_2 | 25.90% | 60.8474 | 2.41E-12 | 67.38% | |
| ERR2017564_k103_78038_2 | 28.60% | 61.2326 | 2.42E-12 | 68.46% | |
| G140996_k105_18907_1 | 27.80% | 61.2326 | 2.42E-12 | 67.74% | |
| ERR2017650_k103_99395_4 | 29.40% | 60.8474 | 2.50E-12 | 60.93% | |
| MSM5ZOJY_P_R_k105_33180_2 | 27.00% | 60.8474 | 2.50E-12 | 67.38% | |
| CSM79HQB_R_k105_43407_16 | 29.10% | 61.2326 | 2.59E-12 | 68.46% | |
| G72676_k105_18744_53 | 30.20% | 60.8474 | 2.62E-12 | 68.46% | |
| CSM67UAU_R_k105_11488_13 | 29.10% | 61.2326 | 2.62E-12 | 68.46% | |
| G140954_k105_94671_2 | 27.10% | 60.8474 | 2.70E-12 | 60.93% | |
| MSM5LLF4_R_k105_25657_4 | 30.20% | 61.2326 | 2.81E-12 | 68.46% | |
| HSMA33KS_R_k105_5109_4 | 27.00% | 60.8474 | 3.03E-12 | 67.74% | |
| G105057_k105_67836_12 | 28.90% | 60.8474 | 3.08E-12 | 62.01% | |
| ERR2017624_k103_11821_2 | 27.70% | 60.8474 | 3.12E-12 | 59.86% | |
| G141100_k105_58729_3 | 25.30% | 60.8474 | 3.34E-12 | 67.74% | |
| ERR2017532_k103_111285_139 | 27.40% | 60.8474 | 3.38E-12 | 69.18% | |
| ERR2017554_k103_9322_8 | 29.30% | 60.4622 | 3.43E-12 | 47.31% | |
| G36350_k105_22840_9 | 26.40% | 60.4622 | 3.44E-12 | 68.46% | |
| PSM7J14L_R_k105_1274_57 | 29.90% | 60.8474 | 3.47E-12 | 69.18% | |
| ERR2017619_k103_60835_2 | 29.20% | 60.8474 | 3.65E-12 | 68.46% | |
| G140880_k105_25835_2 | 29.20% | 60.4622 | 3.69E-12 | 68.82% | |
| ERR2017720_k103_279_5 | 27.20% | 60.077 | 3.86E-12 | 75.63% | |
| G140808_k105_19783_1 | 26.60% | 60.8474 | 3.90E-12 | 67.74% | |
| G104834_k105_65261_6 | 28.30% | 60.4622 | 4.04E-12 | 67.74% | |
| ERR2017606_k103_18959_5 | 28.30% | 62.003 | 4.11E-12 | 62.01% | |
| HSM5MD4B_P_R_k105_8794_2 | 29.20% | 60.4622 | 4.34E-12 | 68.46% | |
| G48817_k105_52454_2 | 27.00% | 60.4622 | 4.37E-12 | 67.38% | |
| ERR2017522_k103_4715_2 | 26.70% | 60.4622 | 4.39E-12 | 68.46% | |
| G89089_k105_4922_3 | 25.30% | 60.4622 | 4.49E-12 | 67.74% | |
| G104926_k105_37453_1 | 27.10% | 60.4622 | 4.48E-12 | 67.74% | |
| G88892_k105_8741_4 | 25.50% | 60.4622 | 4.51E-12 | 90.68% | |
| MSM5LLE3_P_R_k105_3198_2 | 25.30% | 60.4622 | 4.52E-12 | 67.74% | |
| G88845_k105_5494_1 | 26.50% | 60.077 | 4.54E-12 | 67.38% | |
| G89074_k105_22024_1 | 24.70% | 60.8474 | 4.57E-12 | 91.40% | |
| G140845_k105_90412_3 | 24.20% | 60.8474 | 4.62E-12 | 88.53% | |
| G48820_k105_13922_236 | 25.90% | 60.8474 | 4.76E-12 | 60.22% | |
| G72733_k105_12944_3 | 27.10% | 60.4622 | 4.84E-12 | 67.74% | |
| ERR2017413_k93_8044_86 | 27.10% | 60.4622 | 4.93E-12 | 67.74% | |
| G140893_k105_29308_2 | 27.30% | 60.077 | 4.99E-12 | 67.74% | |
| G89089_k105_38776_4 | 27.70% | 60.077 | 5.20E-12 | 68.46% | |
| G105059_k105_1027_2 | 27.30% | 60.077 | 5.29E-12 | 67.74% | |
| G88962_k105_36994_4 | 26.80% | 60.077 | 5.50E-12 | 67.74% | |
| ERR2017626_k103_17966_3 | 26.90% | 60.077 | 5.55E-12 | 67.74% | |
| G48814_k105_11470_43 | 29.80% | 60.4622 | 5.59E-12 | 66.67% | |
| G141820_k105_1664_7 | 27.10% | 60.077 | 5.76E-12 | 67.74% | |
| G88975_k105_91712_4 | 30.20% | 60.077 | 5.78E-12 | 68.46% | |
| ERR2017495_k79_53186_2 | 28.30% | 60.077 | 6.01E-12 | 67.03% | |
| G140163_k105_13531_17 | 28.20% | 60.077 | 6.06E-12 | 67.74% | |
| G105035_k105_44000_30 | 27.30% | 60.077 | 6.31E-12 | 67.74% | |
| ERR2017648_k103_43517_8 | 27.30% | 60.077 | 6.31E-12 | 67.74% | |
| ERR2017576_k103_10527_2 | 27.30% | 60.077 | 6.31E-12 | 67.74% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| ERR2017651_k103_23084_12 | 25.30% | 60.4622 | 6.38E-12 | 67.74% | |
| ERR2017638_k103_20377_1 | 28.40% | 60.077 | 6.46E-12 | 68.10% | |
| ERR2017628_k103_93284_1 | 28.00% | 59.6918 | 6.57E-12 | 75.27% | |
| G88870_k105_21701_1 | 30.30% | 58.5362 | 6.73E-12 | 50.90% | |
| G140180_k105_17929_2 | 27.40% | 60.077 | 7.06E-12 | 62.01% | |
| ERR2017659_k103_111452_5 | 34.10% | 59.6918 | 7.15E-12 | 43.73% | |
| HSM7J4QZ_R_k105_31837_2 | 25.30% | 60.077 | 7.63E-12 | 67.74% | |
| ERR2017554_k103_14928_2 | 25.80% | 59.6918 | 8.08E-12 | 67.74% | |
| G140770_k105_36016_5 | 28.30% | 59.6918 | 8.14E-12 | 62.01% | |
| G88960_k105_14418_90 | 27.40% | 59.6918 | 8.41E-12 | 62.01% | |
| G48820_k105_8566_54 | 30.50% | 59.6918 | 8.52E-12 | 67.74% | |
| G88786_k105_57521_17 | 27.00% | 60.077 | 8.53E-12 | 72.40% | |
| ERR2017579_k103_111919_81 | 27.30% | 59.6918 | 8.66E-12 | 67.74% | |
| G104973_k105_24055_21 | 26.80% | 59.6918 | 8.74E-12 | 67.74% | |
| G48795_k105_40107_2 | 29.20% | 59.3066 | 9.17E-12 | 45.88% | |
| ERR2017626_k103_33873_3 | 25.90% | 59.3066 | 9.43E-12 | 67.74% | |
| ERR2017576_k103_48025_66 | 27.90% | 59.3066 | 9.50E-12 | 64.87% | |
| ERR2017658_k103_28160_2 | 27.90% | 59.6918 | 9.53E-12 | 68.46% | |
| G48831_k105_35349_54 | 26.40% | 59.6918 | 1.00E-11 | 67.74% | |
| G48791_k105_224813_2 | 29.10% | 59.6918 | 1.05E-11 | 59.50% | |
| G48792_k105_106365_2 | 27.30% | 59.3066 | 1.09E-11 | 67.38% | |
| G141113_k105_118013_6 | 25.30% | 59.3066 | 1.09E-11 | 67.74% | |
| G105090_k105_15529_94 | 29.40% | 59.6918 | 1.11E-11 | 60.22% | |
| PSMA265T_R_k105_40770_3 | 25.30% | 59.3066 | 1.13E-11 | 67.74% | |
| G48817_k105_184091_4 | 26.00% | 58.9214 | 1.16E-11 | 70.97% | |
| ERR2017698_k103_49777_6 | 30.00% | 59.3066 | 1.18E-11 | 67.74% | |
| G140896_k105_63696_15 | 28.90% | 58.9214 | 1.23E-11 | 66.31% | |
| G140753_k105_21915_5 | 28.90% | 58.9214 | 1.23E-11 | 66.31% | |
| G72696_k105_6532_37 | 28.40% | 59.3066 | 1.24E-11 | 68.10% | |
| G141050_k105_12742_2 | 29.80% | 58.9214 | 1.25E-11 | 68.10% | |
| G140125_k105_53229_1 | 29.00% | 58.9214 | 1.26E-11 | 71.33% | |
| HSM7CYZF_R_k105_11181_2 | 30.20% | 58.9214 | 1.29E-11 | 68.82% | |
| ERR2017460_k93_22250_1 | 25.70% | 59.3066 | 1.30E-11 | 67.74% | |
| ERR2017460_k93_5217_6 | 26.00% | 59.3066 | 1.31E-11 | 62.01% | |
| MSM6J2HP_R_k105_26003_9 | 27.90% | 58.5362 | 1.32E-11 | 60.57% | |
| ERR2017713_k103_3738_16 | 28.40% | 59.3066 | 1.35E-11 | 67.03% | |
| G72705_k105_5088_76 | 30.20% | 58.9214 | 1.39E-11 | 66.67% | |
| G139971_k105_23554_2 | 29.10% | 59.3066 | 1.40E-11 | 67.38% | |
| G140062_k105_19280_1 | 24.20% | 59.3066 | 1.43E-11 | 67.74% | |
| G105052_k105_26641_1 | 26.00% | 58.9214 | 1.44E-11 | 62.01% | |
| ERR2017693_k103_2028_5 | 25.00% | 58.9214 | 1.47E-11 | 76.70% | |
| G139954_k105_43288_2 | 28.50% | 58.9214 | 1.48E-11 | 70.61% | |
| G140099_k105_49983_2 | 26.00% | 58.9214 | 1.48E-11 | 67.74% | |
| G140758_k105_498_2 | 26.50% | 58.9214 | 1.49E-11 | 72.40% | |
| G140133_k105_11020_2 | 27.20% | 58.9214 | 1.63E-11 | 69.53% | |
| G140922_k105_40896_2 | 27.80% | 58.9214 | 1.65E-11 | 68.82% | |
| G72697_k105_88675_3 | 26.60% | 58.9214 | 1.68E-11 | 67.74% | |
| G104914_k105_101352_13 | 26.70% | 58.5362 | 1.71E-11 | 65.95% | |
| G88708_k105_510_1 | 35.60% | 56.6102 | 1.73E-11 | 36.92% | |
| G36350_k105_2049_35 | 29.20% | 58.5362 | 1.81E-11 | 60.93% | |
| G88910_k105_83216_3 | 28.10% | 58.5362 | 1.86E-11 | 68.46% | |
| ERR2017519_k103_1064_28 | 25.70% | 58.5362 | 1.88E-11 | 68.10% | |
| G141016_k105_90141_1 | 26.20% | 58.9214 | 1.94E-11 | 67.74% | |
| G140043_k105_39728_24 | 26.90% | 58.5362 | 1.95E-11 | 67.74% | |
| G88869_k105_4784_2 | 25.30% | 58.5362 | 2.14E-11 | 67.74% | |
| G48807_k105_125840_2 | 27.60% | 58.5362 | 2.18E-11 | 67.74% | |
| MSM79HF7_R_k105_56275_7 | 25.30% | 58.5362 | 2.18E-11 | 67.74% | |
| G141819_k105_8524_2 | 30.50% | 58.5362 | 2.19E-11 | 68.10% | |
| G104910_k105_55912_2 | 28.00% | 57.3806 | 2.26E-11 | 45.88% | |
| ERR2017462_k103_108422_2 | 26.40% | 58.5362 | 2.29E-11 | 67.74% | |
| ERR2017541_k103_60115_6 | 28.40% | 58.5362 | 2.32E-11 | 66.67% | |
| ERR2017631_k103_13007_10 | 29.60% | 58.5362 | 2.33E-11 | 69.18% | |
| G140771_k105_65449_1 | 29.30% | 58.151 | 2.36E-11 | 60.93% | |
| PSM7J161_R_k105_6805_14 | 27.40% | 58.151 | 2.48E-11 | 68.46% | |
| G88881_k105_12287_8 | 25.30% | 58.5362 | 2.50E-11 | 67.74% | |
| G48780_k105_9281_60 | 32.70% | 57.7658 | 2.55E-11 | 36.92% | |
| HSMA33KQ_R_k105_3667_2 | 26.30% | 58.5362 | 2.60E-11 | 67.74% | |
| G105040_k105_25904_18 | 31.00% | 58.151 | 2.71E-11 | 69.89% | |
| ERR2017530_k103_41367_4 | 29.60% | 58.151 | 2.76E-11 | 44.09% | |
| PSM7J12J_R_k105_5405_1 | 26.80% | 58.151 | 2.80E-11 | 67.74% | |
| G48787_k105_123364_2 | 25.50% | 58.151 | 2.88E-11 | 67.74% | |
| G141007_k105_11427_62 | 26.30% | 58.151 | 2.90E-11 | 67.74% | |
| ERR2017651_k103_285_5 | 27.70% | 58.151 | 2.95E-11 | 67.74% | |
| G140848_k105_69541_3 | 25.30% | 58.151 | 2.99E-11 | 67.74% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G48819__k105__14733__12 | 28.70% | 58.151 | 3.11E-11 | 68.46% | |
| G104977__k105__77974__2 | 29.40% | 58.151 | 3.15E-11 | 67.74% | |
| G48791__k105__6352__2 | 29.90% | 58.151 | 3.22E-11 | 61.65% | |
| G48821__k105__1926__9 | 26.30% | 58.151 | 3.26E-11 | 67.74% | |
| G140829__k105__55892__2 | 26.80% | 58.151 | 3.30E-11 | 67.74% | |
| G104871__k105__77635__8 | 25.40% | 57.7658 | 3.30E-11 | 67.74% | |
| ERR2017694__k103__130139__10 | 25.90% | 57.7658 | 3.46E-11 | 67.74% | |
| G105069__k105__35867__2 | 33.30% | 57.3806 | 3.51E-11 | 39.43% | |
| G104945__k105__16762__21 | 25.00% | 58.151 | 3.52E-11 | 69.53% | |
| ERR2017634__k103__114035__2 | 24.70% | 58.151 | 3.59E-11 | 67.74% | |
| ERR2017574__k103__87688__6 | 24.50% | 57.7658 | 3.66E-11 | 68.10% | |
| ERR2017627__k103__3363__35 | 29.70% | 57.7658 | 3.67E-11 | 68.10% | |
| CSM67UEW__TR__R__k105__27826__2 | 26.00% | 57.7658 | 3.73E-11 | 62.01% | |
| ERR2017460__k93__16182__3 | 25.50% | 57.7658 | 3.77E-11 | 67.74% | |
| ERR2017696__k103__26704__7 | 24.70% | 58.151 | 3.99E-11 | 67.74% | |
| ERR2017641__k103__93336__11 | 24.70% | 57.7658 | 4.03E-11 | 67.74% | |
| G141056__k105__67185__1 | 27.80% | 57.7658 | 4.15E-11 | 65.23% | |
| G140946__k105__73316__8 | 25.90% | 57.7658 | 4.19E-11 | 67.74% | |
| G141002__k105__9813__5 | 26.30% | 57.3806 | 4.75E-11 | 68.46% | |
| ERR2017454__k93__11122__1 | 26.80% | 57.7658 | 4.79E-11 | 67.74% | |
| G140834__k105__17762__1 | 27.00% | 57.7658 | 4.92E-11 | 65.59% | |
| G141013__k105__44163__3 | 25.80% | 57.3806 | 5.02E-11 | 79.93% | |
| ERR2017564__k103__39580__13 | 27.20% | 57.3806 | 5.03E-11 | 77.78% | |
| ERR2017434__k93__92272__8 | 26.70% | 57.3806 | 5.03E-11 | 67.74% | |
| G88896__k105__43136__7 | 28.60% | 57.3806 | 5.19E-11 | 68.46% | |
| G141014__k105__19866__163 | 25.90% | 57.3806 | 5.22E-11 | 68.10% | |
| G140884__k105__48512__1 | 26.30% | 57.3806 | 5.80E-11 | 67.74% | |
| ERR2017646__k103__86310__2 | 28.90% | 56.9954 | 6.02E-11 | 67.74% | |
| G88872__k105__25872__1 | 25.40% | 57.3806 | 6.25E-11 | 62.01% | |
| ERR2017468__k103__65700__23 | 26.80% | 57.3806 | 6.34E-11 | 67.74% | |
| ERR2017570__k103__33081__67 | 24.70% | 57.3806 | 6.42E-11 | 67.74% | |
| PSM7J12V__R__k105__8672__7 | 26.00% | 56.9954 | 6.57E-11 | 67.74% | |
| ERR2017545__k103__29168__2 | 26.30% | 55.8398 | 6.79E-11 | 61.29% | |
| ERR2017686__k103__93964__6 | 28.50% | 56.9954 | 6.87E-11 | 50.18% | |
| G89146__k105__68058__13 | 26.60% | 56.9954 | 6.87E-11 | 67.74% | |
| G141087__k105206502 | 26.00% | 56.9954 | 6.87E-11 | 62.01% | |
| G48790__k105__187226__3 | 25.60% | 56.9954 | 6.93E-11 | 66.67% | |
| G139987__k105__11001__9 | 25.70% | 56.9954 | 7.27E-11 | 62.01% | |
| ERR2017629__k103__21994__3 | 24.70% | 56.9954 | 7.34E-11 | 67.74% | |
| G140994__k105__55384__2 | 28.40% | 57.3806 | 7.38E-11 | 71.33% | |
| G88882__k105__9670__1 | 24.70% | 56.9954 | 7.41E-11 | 67.74% | |
| G140134__k105__88254__18 | 26.10% | 56.9954 | 7.57E-11 | 62.01% | |
| ERR2017666__k103__7267__44 | 26.90% | 56.9954 | 7.60E-11 | 66.67% | |
| G140031__k105__81237__3 | 24.50% | 56.9954 | 7.60E-11 | 69.53% | |
| CSM79HNK__R__k105__14655__2 | 24.70% | 56.9954 | 8.05E-11 | 67.74% | |
| ERR2017736__k103__95772__1 | 25.40% | 56.9954 | 8.28E-11 | 62.01% | |
| G104973__k105__47504__1 | 29.80% | 56.9954 | 8.39E-11 | 66.67% | |
| G104818__k105__45893__2 | 24.90% | 56.9954 | 8.62E-11 | 62.01% | |
| HSM5MD5B__R__k105__31299__2 | 26.30% | 56.9954 | 8.86E-11 | 67.74% | |
| G105093__k105__60548__9 | 25.50% | 56.9954 | 8.87E-11 | 67.74% | |
| G141087__k105__37700__1 | 26.00% | 56.6102 | 8.90E-11 | 67.74% | |
| ERR2017466__k103__22863__3 | 27.10% | 56.6102 | 8.92E-11 | 67.74% | |
| G89182__k105__59201__11 | 26.00% | 56.6102 | 9.16E-11 | 67.74% | |
| G89199__k105__12311__3 | 25.70% | 56.6102 | 9.30E-11 | 62.01% | |
| ERR2017539__k103__8528__3 | 25.70% | 56.6102 | 9.30E-11 | 62.01% | |
| ERR2017697__k103__1288__2 | 25.80% | 56.6102 | 9.43E-11 | 67.74% | |
| G141094__k105__67169__2 | 25.10% | 56.6102 | 1.01E-10 | 69.53% | |
| G104878__k105__15631__6 | 28.20% | 56.6102 | 1.02E-10 | 61.29% | |
| G140000__k105__61667__2 | 25.70% | 56.6102 | 1.08E-10 | 62.01% | |
| CSM79HM7__R__k105__44927__1 | 29.10% | 56.6102 | 1.10E-10 | 75.99% | |
| G139992__k105__44197__6 | 24.70% | 56.6102 | 1.11E-10 | 67.74% | |
| G48832__k105__14987__2 | 24.10% | 56.6102 | 1.12E-10 | 69.53% | |
| PSM6XBTT__R__k105__52087__2 | 25.30% | 56.6102 | 1.14E-10 | 63.80% | |
| G141086__k105__32575__2 | 28.40% | 56.225 | 1.16E-10 | 79.21% | |
| G141818__k105__30919__10 | 25.70% | 56.6102 | 1.21E-10 | 62.01% | |
| G48792__k105__157266__20 | 25.90% | 56.225 | 1.22E-10 | 67.74% | |
| G140887__k105__14976__1 | 24.20% | 56.225 | 1.22E-10 | 67.74% | |
| CSM67UAA__R__k105__7303__317 | 28.10% | 56.6102 | 1.23E-10 | 74.91% | |
| G141056__k105__82494__6 | 25.50% | 56.225 | 1.23E-10 | 67.74% | |
| G140175__k105__767__1 | 25.40% | 56.225 | 1.37E-10 | 62.01% | |
| ERR2017549__k103__72053__5 | 26.40% | 56.225 | 1.39E-10 | 67.74% | |
| ERR2017697__k103__52134__11 | 26.30% | 56.225 | 1.40E-10 | 66.67% | |
| ERR2017476__k79__78595__6 | 24.20% | 56.225 | 1.40E-10 | 67.74% | |
| G141000__k105__72969__1 | 24.90% | 56.225 | 1.43E-10 | 69.53% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| PSM7J16F__R__k105__18438__2 | 25.40% | 56.225 | 1.44E-10 | 62.01% | |
| ERR2017411__k93__31527__52 | 28.30% | 56.225 | 1.45E-10 | 67.74% | |
| ERR2017581__k103__70168__14 | 28.40% | 56.225 | 1.55E-10 | 65.95% | |
| ERR2017688__k103__101386__9 | 27.40% | 56.225 | 1.57E-10 | 63.80% | |
| G72698__k105__10065__41 | 26.20% | 56.6102 | 1.58E-10 | 68.10% | |
| G105079__k105__46371__3 | 25.80% | 55.8398 | 1.66E-10 | 67.74% | |
| CSM5MCX3__R__k105__456__2 | 24.60% | 55.8398 | 1.68E-10 | 69.53% | |
| PSM7J19R__R__k105__20839__1 | 25.40% | 56.225 | 1.72E-10 | 62.01% | |
| ERR2017430__k93__8706__1 | 26.00% | 55.8398 | 1.77E-10 | 67.74% | |
| G36352__k105__53533__16 | 33.00% | 55.8398 | 1.85E-10 | 67.74% | |
| ERR2017605__k103__16380__2 | 24.90% | 55.8398 | 1.85E-10 | 69.53% | |
| G139982__k105__60115__1 | 26.90% | 55.8398 | 1.88E-10 | 67.74% | |
| G89108__k105__6460__20 | 26.80% | 55.4546 | 1.92E-10 | 67.74% | |
| CSM7KORK__R__k105__41575__13 | 27.10% | 56.225 | 1.93E-10 | 60.22% | |
| CSM67UAA__R__k105__7898__82 | 24.70% | 55.8398 | 1.94E-10 | 67.74% | |
| MSM6J2LL__R__k105__43260__4 | 23.80% | 55.8398 | 1.98E-10 | 67.74% | |
| ERR2017579__k103__138612__5 | 24.40% | 55.8398 | 2.14E-10 | 69.53% | |
| G140109__k105__58927__1 | 24.60% | 55.8398 | 2.15E-10 | 68.10% | |
| G139971__k105__108960__3 | 25.80% | 55.8398 | 2.24E-10 | 67.74% | |
| ERR2017720__k103__2159__4 | 28.20% | 55.4546 | 2.40E-10 | 50.90% | |
| G72675__k105__11974__26 | 27.10% | 55.8398 | 2.48E-10 | 60.22% | |
| PSM7J15M__R__k105__1235__3 | 25.60% | 55.4546 | 2.48E-10 | 67.74% | |
| MSM6J2MH__R__k105__18056__1 | 24.20% | 55.4546 | 2.49E-10 | 67.74% | |
| G104984__k105__97839__1 | 28.90% | 55.0694 | 2.52E-10 | 66.31% | |
| G139981__k105__75402__14 | 28.50% | 55.4546 | 2.68E-10 | 84.59% | |
| G104941__k105__56765__2 | 27.60% | 55.4546 | 2.69E-10 | 67.74% | |
| G141060__k105809042 | 25.30% | 55.4546 | 2.77E-10 | 67.74% | |
| ERR2017564__k103__25576__75 | 25.30% | 55.4546 | 2.77E-10 | 67.74% | |
| ERR2017541__k103__79773__14 | 24.30% | 55.4546 | 2.78E-10 | 62.01% | |
| CSM79HJI__P__R__k105__17388__4 | 26.90% | 55.4546 | 2.80E-10 | 62.01% | |
| ERR2017704__k103__111078__1 | 27.60% | 55.0694 | 2.91E-10 | 68.82% | |
| G140963__k105__66302__2 | 30.70% | 55.4546 | 2.93E-10 | 61.29% | |
| G72712__k105__9819__2 | 24.00% | 55.4546 | 2.98E-10 | 69.53% | |
| ERR2017460__k93__13963__1 | 24.00% | 55.4546 | 3.01E-10 | 69.53% | |
| G140911__k105__2500__6 | 27.20% | 55.0694 | 3.10E-10 | 69.53% | |
| G48804__k105__2722__2 | 27.60% | 55.0694 | 3.HE-10 | 66.67% | |
| MSM6J2LY__R__k105__12804__5 | 24.70% | 55.0694 | 3.11E-10 | 67.74% | |
| G104819__k105__86833__7 | 29.50% | 55.0694 | 3.22E-10 | 59.50% | |
| G88908__k105__27555__3 | 27.50% | 55.0694 | 3.23E-10 | 46.59% | |
| MSM79H81__R__k105__2813__5 | 24.90% | 55.0694 | 3.31E-10 | 67.74% | |
| PSM7J12V__R__k105__11226__13 | 26.40% | 55.0694 | 3.43E-10 | 67.74% | |
| ERR2017489__k79__67320__1 | 24.70% | 55.0694 | 3.46E-10 | 67.74% | |
| G48817__k105__96906__1 | 27.50% | 54.6842 | 3.48E-10 | 68.10% | |
| G36378__k105__21568__3 | 26.70% | 54.6842 | 3.48E-10 | 67.03% | |
| G140017__k105__63911__2 | 26.00% | 55.0694 | 3.55E-10 | 67.74% | |
| ERR2017521__k103__127408__11 | 28.30% | 54.6842 | 3.56E-10 | 66.67% | |
| ERR2017697__k103__62379__7 | 24.40% | 55.0694 | 3.65E-10 | 67.74% | |
| ERR2017570__k103__12631__9 | 29.10% | 54.6842 | 3.66E-10 | 67.38% | |
| G105055__k105__7528__7 | 28.50% | 55.0694 | 3.91E-10 | 72.04% | |
| G89123__k105__8632__2 | 28.20% | 54.6842 | 3.91E-10 | 60.57% | |
| G88927__k105__52848__2 | 24.90% | 55.0694 | 3.91E-10 | 62.01% | |
| G104865__k105__31582__3 | 24.00% | 54.6842 | 4.18E-10 | 69.53% | |
| MSM5ZOJY__P__R__k105__4664__23 | 29.70% | 55.0694 | 4.25E-10 | 68.46% | |
| ERR2017662__k103__17459__1 | 24.90% | 54.6842 | 4.26E-10 | 69.53% | |
| G36356__k105__71558__12 | 24.20% | 54.6842 | 4.26E-10 | 67.74% | |
| PSM7J16I__R__k105__6364__1 | 24.20% | 54.6842 | 4.35E-10 | 67.74% | |
| ERR2017467__k103__84641__2 | 24.00% | 54.6842 | 4.46E-10 | 69.53% | |
| G139981__k105__87138__2 | 25.40% | 54.6842 | 4.48E-10 | 67.74% | |
| G140028__k105__55234__7 | 26.30% | 54.6842 | 4.56E-10 | 62.01% | |
| G141128__k105__2740__4 | 24.90% | 54.6842 | 4.58E-10 | 62.01% | |
| G139958__k105__15426__1 | 25.00% | 54.6842 | 4.59E-10 | 87.46% | |
| ERR2017599__k103__65241__1 | 24.40% | 54.6842 | 4.59E-10 | 69.53% | |
| G141119__k105__5509__2 | 26.00% | 54.6842 | 4.71E-10 | 89.25% | |
| G140812__k105__93116__3 | 25.10% | 54.6842 | 4.77E-10 | 75.99% | |
| ERR2017705__k103__70467__3 | 24.60% | 54.6842 | 4.77E-10 | 67.74% | |
| G141111__k105__5045__1 | 25.50% | 54.6842 | 4.82E-10 | 67.74% | |
| G141094__k105830472 | 25.00% | 54.6842 | 5.30E-10 | 67.74% | |
| ERR2017619__k103__28417__9 | 29.10% | 54.299 | 5.35E-10 | 52.69% | |
| G141047__k105__73005__3 | 27.70% | 53.9138 | 5.57E-10 | 66.67% | |
| G141004__k105__14994__12 | 25.60% | 54.299 | 5.71E-10 | 62.01% | |
| MSM5LLHG__P__R__k105__18354__11 | 25.50% | 54.299 | 5.76E-10 | 67.74% | |
| ERR2017457__k93__25557__5 | 24.20% | 54.299 | 5.94E-10 | 67.74% | |
| ERR2017605__k103__112193__5 | 25.80% | 54.299 | 6.36E-10 | 67.74% | |
| HSM7J4NS__R__k105__64170__5 | 25.30% | 54.299 | 6.74E-10 | 69.18% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G72729_k105_121335_1 | 26.90% | 54.299 | 6.87E-10 | 62.01% | |
| ERR2017468_k103_6496_2 | 25.50% | 54.299 | 6.95E-10 | 67.74% | |
| G140887_k105_60859_3 | 29.20% | 53.9138 | 7.17E-10 | 42.29% | |
| G104933_k105_101346_1 | 26.70% | 53.9138 | 7.27E-10 | 67.74% | |
| G140899_k105_58156_2 | 27.10% | 53.9138 | 7.42E-10 | 67.74% | |
| MSMA26EJ_R_k105_4692_1 | 24.10% | 54.299 | 7.44E-10 | 69.53% | |
| HSM5MD6M_R_k105_982_5 | 24.20% | 54.299 | 7.52E-10 | 67.74% | |
| G89252_k105_71026_2 | 24.60% | 54.299 | 7.53E-10 | 63.80% | |
| G140096_k105_16087_10 | 24.90% | 53.9138 | 7.70E-10 | 67.74% | |
| G140009_k105_42826_4 | 25.50% | 53.9138 | 7.92E-10 | 67.74% | |
| G104946_k105_16056_29 | 25.50% | 53.9138 | 8.00E-10 | 67.74% | |
| G89067_k105_38969_11 | 31.80% | 53.9138 | 8.36E-10 | 60.57% | |
| G140807_k105_54983_2 | 29.50% | 53.9138 | 8.89E-10 | 69.18% | |
| ERR2017586_k103_8649_6 | 23.80% | 53.9138 | 8.92E-10 | 67.74% | |
| G88971_k105_7855_2 | 24.00% | 53.9138 | 9.07E-10 | 69.53% | |
| G89146_k105_42388_2 | 28.80% | 53.9138 | 9.HE-10 | 67.38% | |
| G141067_k105_5153_2 | 25.50% | 53.9138 | 9.55E-10 | 67.74% | |
| CSM5MCUK_P_R_k105_30732_4 | 25.50% | 53.5286 | 1.03E-09 | 67.74% | |
| PSM6XBTR_R_k105_22350_30 | 26.90% | 53.5286 | 1.04E-09 | 67.38% | |
| G105001_k105_20123_2 | 24.40% | 53.5286 | 1.04E-09 | 69.53% | |
| ERR2017731_k103_25150_2 | 24.40% | 53.5286 | 1.04E-09 | 69.53% | |
| MSM5FZ9N_P_R_k105_3455_2 | 27.40% | 53.5286 | 1.08E-09 | 68.10% | |
| ERR2017633_k103_35117_2 | 26.50% | 53.9138 | 1.10E-09 | 60.22% | |
| ERR2017619_k103_10162_2 | 25.00% | 53.5286 | 1.14E-09 | 67.74% | |
| G48838_k105_87654_2 | 22.80% | 53.5286 | 1.14E-09 | 67.74% | |
| G48790_k105_4930_3 | 29.20% | 52.373 | 1.15E-09 | 49.46% | |
| PSM7J14L_R_k105_3549_5 | 28.70% | 53.5286 | 1.15E-09 | 62.37% | |
| G140002_k105_58409_2 | 24.40% | 53.5286 | 1.22E-09 | 69.53% | |
| G140026_k105_32005_1 | 26.30% | 53.1434 | 1.38E-09 | 69.53% | |
| G140845_k105_91673_1 | 28.90% | 53.1434 | 1.41E-09 | 69.18% | |
| CSM79HOZ_R_k105_49806_2 | 28.20% | 53.5286 | 1.45E-09 | 58.42% | |
| ERR2017482_k79_120774_45 | 24.20% | 53.1434 | 1.49E-09 | 67.74% | |
| ERR2017660_k103_107940_2 | 31.40% | 52.7582 | 1.83E-09 | 60.93% | |
| CSM5MCZD_R_k105_14716_4 | 24.40% | 52.7582 | 1.91E-09 | 67.74% | |
| MSM79H9K_R_k105_1646_2 | 29.80% | 52.7582 | 1.98E-09 | 68.46% | |
| ERR2017581_k103_88831_2 | 23.90% | 52.7582 | 1.99E-09 | 69.53% | |
| G141010_k105_32004_3 | 27.40% | 52.7582 | 2.00E-09 | 68.82% | |
| G104885_k105_4212_10 | 26.30% | 52.7582 | 2.01E-09 | 67.74% | |
| ERR2017725_k103_33716_23 | 31.00% | 52.7582 | 2.09E-09 | 51.61% | |
| G88797_k105_19320_2 | 35.50% | 50.447 | 2.22E-09 | 33.33% | |
| ERR2017458_k93_2794_2 | 24.50% | 52.7582 | 2.39E-09 | 67.74% | |
| G140963_k105_3708_2 | 34.10% | 52.7582 | 2.40E-09 | 31.18% | |
| ERR2017540_k103_8816_2 | 28.00% | 52.7582 | 2.45E-09 | 56.99% | |
| G72722_k105_58143_7 | 29.80% | 52.373 | 2.52E-09 | 43.01% | |
| G48841_k105_1396_8 | 23.90% | 52.373 | 2.80E-09 | 81.72% | |
| G48812_k105_53130_1 | 29.00% | 52.7582 | 2.86E-09 | 54.84% | |
| ERR2017528_k103_60282_14 | 34.70% | 50.447 | 3.01E-09 | 34.05% | |
| ERR2017533_k103_21325_9 | 30.10% | 51.9878 | 3.10E-09 | 70.25% | |
| ERR2017454_k93_45104_2 | 29.50% | 51.9878 | 3.12E-09 | 70.25% | |
| G141819_k105_10609_4 | 27.10% | 51.9878 | 3.16E-09 | 69.89% | |
| G140839_k105_35220_4 | 27.60% | 51.9878 | 3.28E-09 | 62.37% | |
| MSM79H81_R_k105_31273_4 | 26.70% | 51.6026 | 3.50E-09 | 66.67% | |
| G141049_k105_10944_7 | 24.50% | 51.9878 | 3.51E-09 | 67.74% | |
| ERR2017551_k103_22818_20 | 28.30% | 51.9878 | 3.77E-09 | 68.10% | |
| ERR2017663_k103_15658_4 | 24.40% | 51.9878 | 4.17E-09 | 69.53% | |
| G36347_k105_21670_29 | 25.80% | 51.6026 | 4.18E-09 | 67.38% | |
| HSM5MD66_R_k105_22541_1 | 25.90% | 52.373 | 4.20E-09 | 68.10% | |
| G105021_k105_94587_3 | 23.50% | 51.9878 | 4.40E-09 | 69.53% | |
| G140929_k105_26270_2 | 23.50% | 51.6026 | 4.82E-09 | 76.34% | |
| G48817_k105_42413_2 | 28.40% | 51.2174 | 5.42E-09 | 68.82% | |
| HSM7CZ36_R_k105_4760_16 | 27.90% | 51.2174 | 5.67E-09 | 68.10% | |
| G140761_k105_44585_1 | 23.90% | 51.6026 | 5.74E-09 | 69.53% | |
| G105092_k105_29528_1 | 23.80% | 51.2174 | 5.88E-09 | 67.74% | |
| G139962_k105_59841_2 | 27.20% | 51.9878 | 6.06E-09 | 68.10% | |
| G139981_k105_10447_2 | 38.20% | 48.9062 | 6.28E-09 | 31.90% | |
| G36369_k105_23328_1 | 25.40% | 51.2174 | 6.73E-09 | 66.67% | |
| MSM5LLGD_P_R_k105_10400_3 | 26.90% | 51.2174 | 7.28E-09 | 59.86% | |
| G139999_k105_27221_4 | 28.60% | 51.2174 | 8.21E-09 | 49.82% | |
| G48802_k105_5208_71 | 29.00% | 50.8322 | 8.54E-09 | 60.22% | |
| MSM5FZ9N_P_R_k105_31088_3 | 35.10% | 50.8322 | 8.57E-09 | 34.77% | |
| G48817_k105_145263_2 | 26.20% | 50.447 | 8.71E-09 | 59.50% | |
| ERR2017449_k93_76238_3 | 27.90% | 50.8322 | 9.63E-09 | 65.95% | |
| CSM67UAA_R_k105_11802_63 | 25.50% | 50.8322 | 1.03E-08 | 82.08% | |
| G141093_k105_17600_1 | 28.60% | 50.447 | 1.17E-08 | 74.55% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G140833_k105_44672_2 | 23.50% | 50.447 | 1.32E−08 | 69.53% | |
| G36385_k105_789_3 | 31.20% | 50.447 | 1.33E−08 | 49.82% | |
| ERR2017519_k103_29366_2 | 28.50% | 50.0618 | 1.37E−08 | 68.46% | |
| CSM79HNI_R_k105_32627_11 | 27.00% | 50.0618 | 1.40E−08 | 66.67% | |
| G36372_k105_15897_3 | 27.80% | 50.0618 | 1.42E−08 | 68.82% | |
| CSM5MCUC_P_R_k105_28589_3 | 32.10% | 50.0618 | 1.53E−08 | 45.52% | |
| G88888_k105_15847_5 | 31.20% | 49.2914 | 2.51E−08 | 60.93% | |
| G48840_k105_54194_2 | 27.90% | 49.6766 | 2.61E−08 | 49.82% | |
| G140976_k105_46880_6 | 31.50% | 47.3654 | 2.71E−08 | 32.97% | |
| G48817_k105_32541_37 | 33.30% | 47.3654 | 2.88E−08 | 43.01% | |
| ESM718V8_R_k105_32821_1 | 27.10% | 48.9062 | 3.32E−08 | 50.90% | |
| ERR2017617_k103_41720_5 | 25.70% | 48.9062 | 3.89E−08 | 60.93% | |
| PSM7J15A_R_k105_38110_2 | 35.10% | 48.9062 | 4.11E−08 | 34.77% | |
| G48820_k105_15464_23 | 31.50% | 46.2098 | 5.21E−08 | 31.90% | |
| ERR2017475_k79_17860_3 | 27.20% | 48.1358 | 5.94E−08 | 65.95% | |
| G105029_k105_87332_1 | 32.60% | 46.595 | 7.56E−08 | 32.97% | |
| ERR2017592_k103_10557_6 | 26.20% | 47.7506 | 8.03E−08 | 67.74% | |
| G104825_k105_87732_1 | 24.90% | 47.3654 | 9.19E−08 | 73.84% | |
| G72728_k105_18244_1 | 29.80% | 47.3654 | 1.17E−07 | 63.44% | |
| CSM67UEI_R_k105_6374_31 | 29.60% | 47.3654 | 1.29E−07 | 49.46% | |
| MSM79H87_R_k105_25507_1 | 28.90% | 46.9802 | 1.33E−07 | 43.01% | |
| ERR2017577_k103_97291_2 | 27.30% | 47.3654 | 1.33E−07 | 39.07% | |
| G89185_k105_33406_4 | 31.50% | 47.3654 | 1.47E−07 | 38.71% | |
| G105094_k105_75363_1 | 31.50% | 47.3654 | 1.50E−07 | 38.71% | |
| G36375_k105_12579_7 | 24.20% | 46.2098 | 2.90E−07 | 67.74% | |
| G89185_k105_61177_1 | 28.50% | 44.669 | 3.82E−07 | 45.52% | |
| G139999_k105_69212_4 | 26.40% | 45.8246 | 3.96E−07 | 68.10% | |
| ERR2017602_k103_62451_1 | 26.80% | 45.4394 | 4.39E−07 | 50.18% | |
| G140001_k105_81535_1 | 31.90% | 42.743 | 8.01E−07 | 32.62% | |
| G89065_k105_45479_45 | 30.70% | 44.669 | 9.34E−07 | 45.16% | |
| G140887_k105_44653_5 | 30.60% | 44.669 | 1.09E−06 | 38.71% | |
| ERR2017580_k103_44400_2 | 33.30% | 41.9726 | 1.37E−06 | 34.77% | |
| G48819_k105_1753_164 | 28.40% | 42.3578 | 1.56E−06 | 41.58% | |
| MSM5LLH2_P_R_k105_885_16 | 26.70% | 42.743 | 3.62E−06 | 46.95% | |
| G140994_k105_16303_2 | 24.80% | 42.743 | 3.90E−06 | 41.22% | |
| G36387_k105_11202_1 | 35.20% | 40.817 | 4.32E−06 | 32.62% | |
| G105079_k105_29139_2 | 31.30% | 42.743 | 4.56E−06 | 35.48% | |
| G104949_k105_52018_2 | 27.50% | 41.5874 | 4.61E−06 | 49.82% | |
| G36356_k105_43864_15 | 25.00% | 42.743 | 4.69E−06 | 57.35% | |
| ERR2017540_k103_42745_1 | 30.10% | 40.817 | 5.05E−06 | 35.84% | |
| G105024_k105_41543_4 | 27.70% | 40.4318 | 5.37E−06 | 33.69% | |
| ERR2017613_k103_40340_1 | 31.30% | 40.0466 | 8.21E−06 | 33.33% | |
| ERR2017598_k103_113995_3 | 28.90% | 40.4318 | 8.51E−06 | 34.41% | |
| MSM79HAJ_R_k105_37312_4 | 32.20% | 41.9726 | 8.97E−06 | 31.90% | |
| ERR2017534_k103_104387_3 | 29.90% | 41.2022 | 9.90E−06 | 31.18% | |
| G89185_k105_33406_4 | 35.40% | 41.5874 | 1.02E−05 | 27.96% | |
| G140997_k105_35665_5 | 28.50% | 39.6614 | 1.53E−05 | 40.50% | |
| G140887_k105_44653_5 | 35.40% | 40.817 | 2.01E−05 | 27.96% | |
| G48790_k105_60374_4 | 38.20% | 37.7354 | 4.34E−05 | 24.37% | |
| G140776_k105_17588_1 | 35.50% | 38.891 | 5.92E−05 | 21.86% | |
| ERR2017681_k103_2642_3 | 27.10% | 38.891 | 6.26E−05 | 58.78% | |
| ERR2017716_k103_34026_6 | 27.90% | 38.891 | 7.42E−05 | 69.89% | |
| G140139_k105_54286_26 | 37.60% | 38.891 | 8.27E−05 | 32.97% | |
| ERR2017652_k103_98787_1 | 32.10% | 36.5798 | 9.69E−05 | 30.11% | |
| ERR2017644_k103_67649_37 | 26.60% | 38.1206 | 1.07E−04 | 69.89% | |
| G140123_k105_32078_1 | 31.00% | 37.3502 | 1.12E−04 | 29.75% | |
| HSM5MD53_R_k105_1522_8 | 28.90% | 36.965 | 1.22E−04 | 34.77% | |
| G104937_k105_52467_1 | 37.30% | 36.965 | 1.29E−04 | 21.86% | |
| ERR2017697_k103_36639_1 | 43.80% | 36.1946 | 1.81E−04 | 17.20% | |
| G104886_k105_52538_2 | 27.60% | 36.965 | 2.48E−04 | 31.18% | |
| ERR2017703_k103_30121_38 | 40.00% | 37.3502 | 2.86E−04 | 14.34% | |
| ERR2017631_k103_68539_5 | 27.00% | 36.965 | 2.87E−04 | 53.76% | |
| G140771_k105_40685_1 | 21.90% | 36.965 | 3.16E−04 | 67.74% | |
| G105094_k105_75363_1 | 33.30% | 36.965 | 3.40E−04 | 27.60% | |
| G140933_k105_12475_3 | 32.20% | 36.5798 | 4.84E−04 | 31.18% | |
| G140776_k105_17588_1 | 29.20% | 35.8094 | 6.25E−04 | 31.54% | |
| G36363_k105_20747_22 | 25.90% | 35.4242 | 8.33E−04 | 60.93% | |
| G88749_k105_59786_2 | 37.00% | 33.8834 | 1.97E−03 | 26.16% | |
| HSM7CZ1C_R_k105_20468_2 | 30.80% | 32.3452 | 2.28E−03 | 31.18% | |
| G48790_k105_120264_12 | 27.60% | 33.8834 | 2.29E−03 | 31.18% | |
| G89054_k105_1721_14 | 23.80% | 33.4982 | 3.53E−03 | 60.93% | |
| ERR2017638_k103_84845_5 | 23.30% | 33.4982 | 3.55E−03 | 60.93% | |
| CSM7KOS7_R_k105_6489_46 | 30.40% | 32.7278 | 6.12E−03 | 44.80% | |
| ERR2017587_k103_55676_25 | 27.00% | 32.7278 | 6.57E−03 | 67.38% | |

TABLE 9-continued

Results from the Blast search of the combined assembly using ECOP170 as the query.

| Name | % Pair wise Identity | Bit-Score | E Value | Query coverage | Comments/ CAG numbers if relevant |
|---|---|---|---|---|---|
| G72722_k105_89343_1 | 23.00% | 32.3426 | 7.55E−03 | 31.18% | |
| G88838_k105_81324_2 | 26.40% | 30.8018 | 2.71E−02 | 31.18% | |
| G141119_k105_18175_1 | 23.30% | 29.6462 | 4.21E−02 | 31.90% | |
| MSM9VZIY_R_k105_2858_10 | 45.70% | 29.261 | 4.24E−02 | 12.19% | |

Figure 2B:
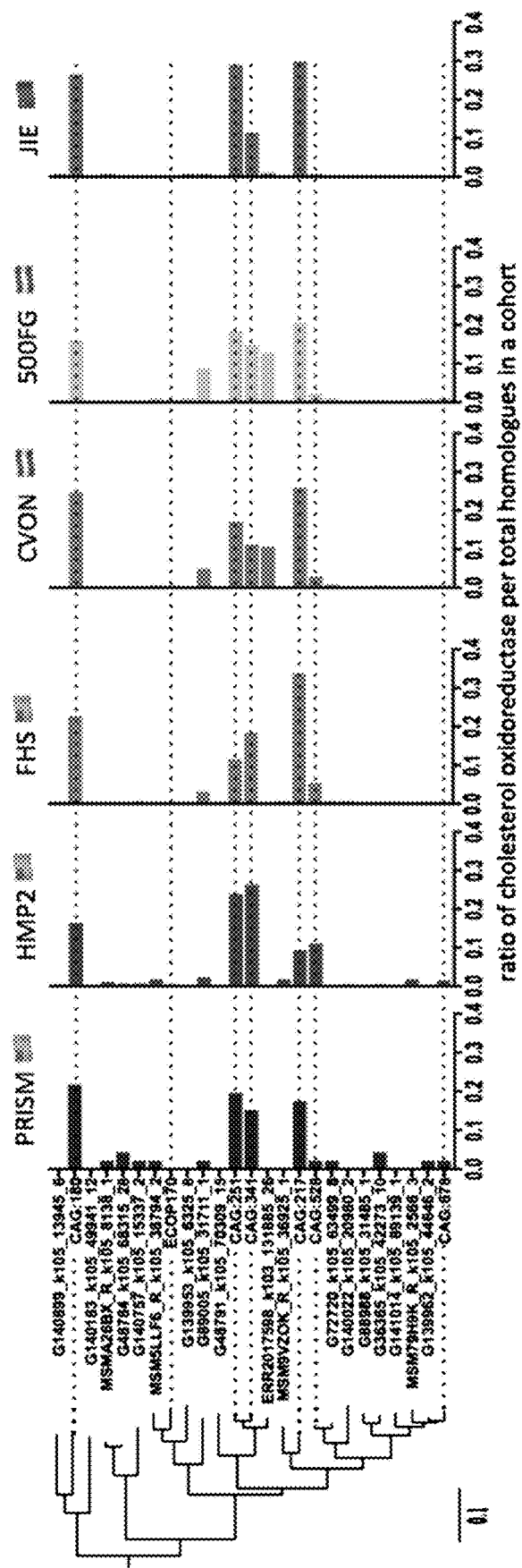
Figure 8A:
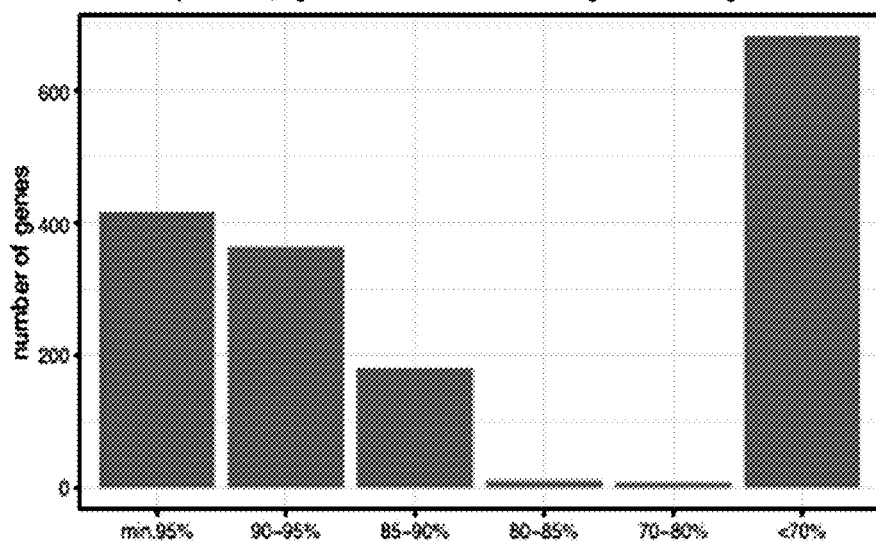
FIG. 8A-8D *E. coprostanoligenes* is rarely observed in the human gut microbiome.
Figure 8B:
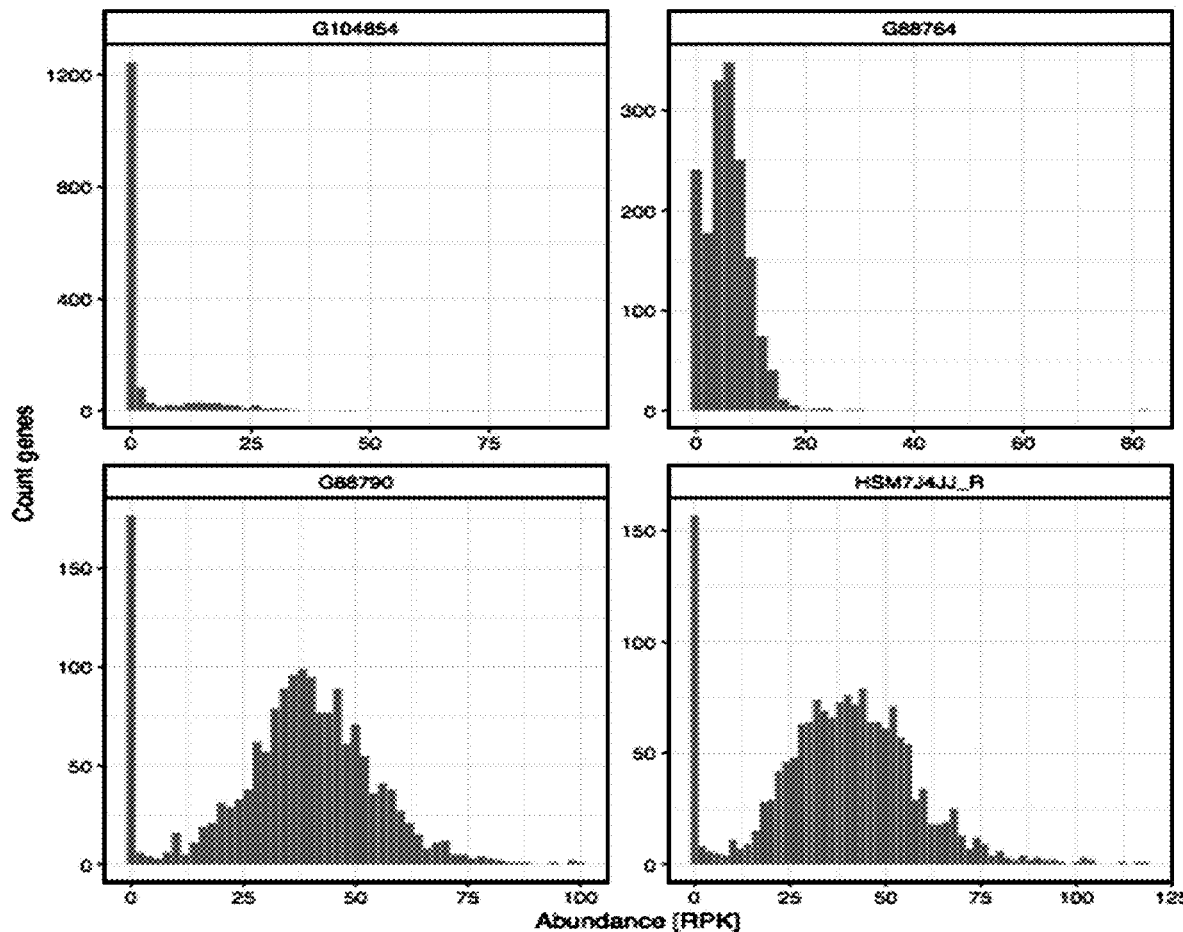
Figure 8C:
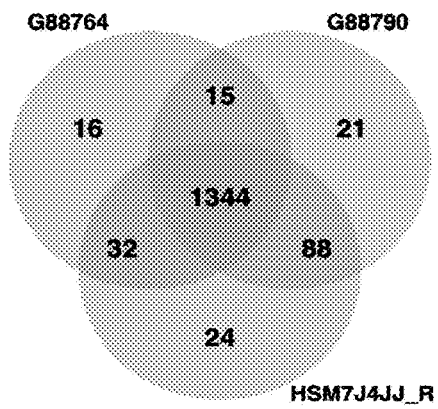
Figure 8D:
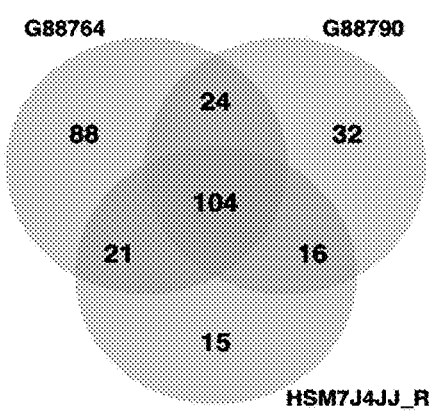

The COR homologs Applicants characterized in vitro represent the most prevalent homologs found in all of the datasets, with CORs previously binned into co-abundant gene groups (CAGs), i.e., microbial species that lacked cultured representatives and were only identified in gut microbiome assemblies, CAG:180, CAG:251, CAG:341, and CAG:217 being the most prevalent in all six cohorts, albeit at different levels (FIG. 2B). One other homolog that was not characterized experimentally above, ERR2017598_k103_131885_26, was found to be prevalently encoded specifically in the gut microbiomes from the two Dutch cohorts (>10% cor+ samples), which suggests that some underlying country specific factors might be driving colonization with different cor+ bacteria. Notably, one of the cor genes that were identified in 4 samples, G88790_k105_50573_1, showed a high sequence similarity to the *E. coprostanoligenes* cor gene (ECOP170) with 98.7% DNA and 99.2% AA similarity (1 lbp and 2AA differences, respectively), while another ~400 *E. coprostanoligenes* genes showed strong homology to other genes from the assembled gene catalogue (FIG. 8A). This only partial recovery of *E. coprostanoligenes* genes through metagenomic assembly suggest that it is a low abundant and rare species in human populations. To further validate its presence in the 4 samples encoding the *E. coprostanoligenes* COR homolog, Applicants mapped their gut metagenomes to the assembled gene catalogue that was augmented with *E. coprostanoligenes* genes and detected 85-90% of *E. coprostanoligenes* genes in 3 samples (FIG. 8B). Between these samples, 1344 and 104 *E. coprostanoligenes* genes were commonly detected and undetected out of the genes in the *E. coprostanoligenes* genome (FIG. 8C, 8D). Altogether this indicates that *F. coprostanoligenes* is a rare human-associated cor+ microbe (3 of 3,142 samples, 0.095% of samples) of whose human-associated strains are distinct from the hog sewage lagoon isolate.

Figure 3:
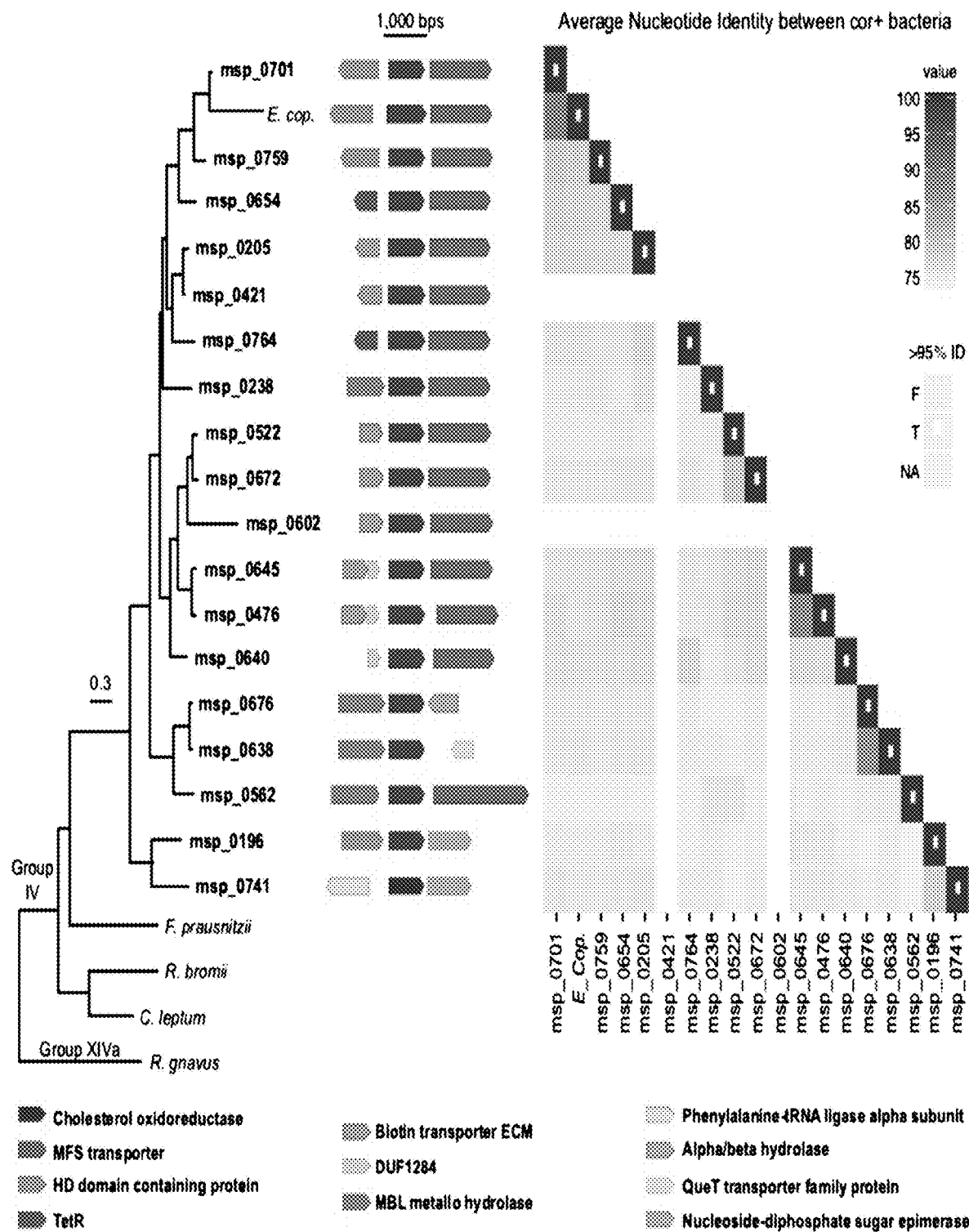
FIG. 3 Human gut bacteria containing cholesterol oxidoreductase are uncultured members of group IV *Clostridium*. 18 different metagenomics species (msp) containing a cholesterol oxidoreductase gene could be identified across the combined assemblies of microbiomes. This analysis recovered all of the metagenomics assemblies already deposited in the NCBI database (CAG:251, CAG:341, CAG:217, CAG:678, CAG:528, CAG:180). To determine the genomic context around each cor gene, contigs were assembled from stool samples containing the highest number of reads against each of the 18 metagenomic species. Most of the cor genes are found neighboring an MFS transporter (red) and a biotin transporter (light green). The average nucleotide identity (ANI) was computed between all of the genomes that could be reconstructed from metagenomes. The two MSPs without complete genomes are shown as white boxes. ANI scores between two MSPs that are greater than 95% (likely indicating the same species), are marked with a hollow center.

The remaining 24 cor genes that were detected in 99% of cor+ microbiomes could not be mapped back to any publicly available microbial reference genome. In order to determine the organisms encoding them, Applicants binned the assembled metagenomes into metagenomic species (MSPs) using MSPminer[26]. With this approach, 18 of the 25 homologs were successfully assigned to individual MSPs. Similarity based annotation of these organisms to a species level using a comprehensive collection of microbial isolates published to date was unsuccessful, suggesting that most cholesterol-metabolizing human gut bacteria are indeed novel and previously uncharacterized. To aid in taxonomic annotation, Applicants compared phylogenetic distance between these species and known isolates using a set of single copy marker genes (PhyloPhlAn[27]). In the bacterial tree of life, the 18 COR encoding MSPs and *E. coprostanoligenes* form a coherent clade that phylogenetically neighbors with *Clostridium* cluster IV, which includes species such as *Faecalibacterium prausnitzii*, and Ruminococcus bromii (FIG. 3). This group of organisms possesses metabolic capabilities that are linked to host health, including butyrate production.[28]

Understanding the other genes involved in coprostanol formation may help us learn more about how this metabolic pathway works and what roles it might serve in gut bacteria. Since it is common for genes involved in the same metabolic pathway to be co-localized within a bacterial genome, Applicants wanted to determine if there is a conserved coprostanol biosynthetic operon across the cor+ metagenomic species. To identify conserved genetic elements neighboring the cor genes, Applicants assembled contigs containing each unique cor gene from the stool metagenomes previously found to have the highest abundance of the desired metagenomics species. ORFs were called on these contigs and neighboring genes were identified. The most common gene directly downstream of the cholesterol oxidoreductase gene encodes an uncharacterized MFS transporter (14/18 msps). Because this family of transporters is used in bile acid metabolism, Applicants hypothesize this gene plays a role in cholesterol transport.[29] None of the other neighboring genes are conserved in all of the metagenomics species, nor do they encode enzymes with the catalytic capabilities needed to perform transformations on cholesterol or related molecules, which suggests a lack of a conserved coprostanol biosynthetic operon. This finding is consistent with previous studies of other steroid-metabolizing pathways in bacteria.[30]

Figure 4A:
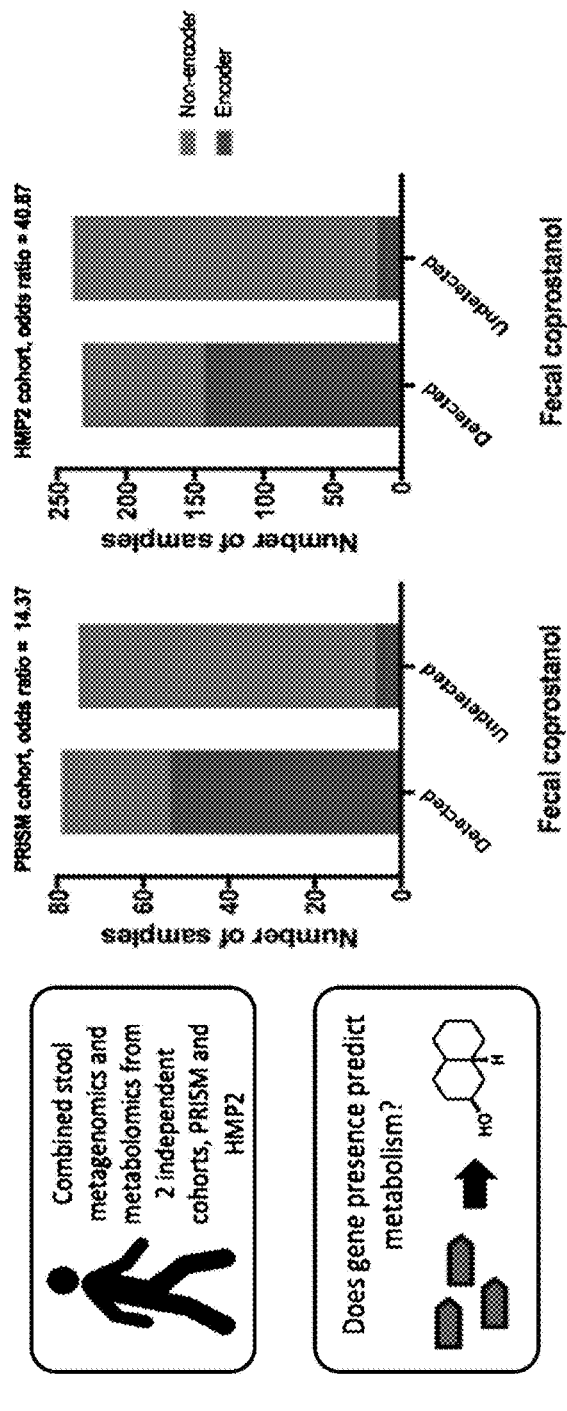
FIG. 4A-4C Fecal coprostanol formation is correlated to the presence of one of the 25 cholesterol oxidoreductase homologs.
Figure 4B:
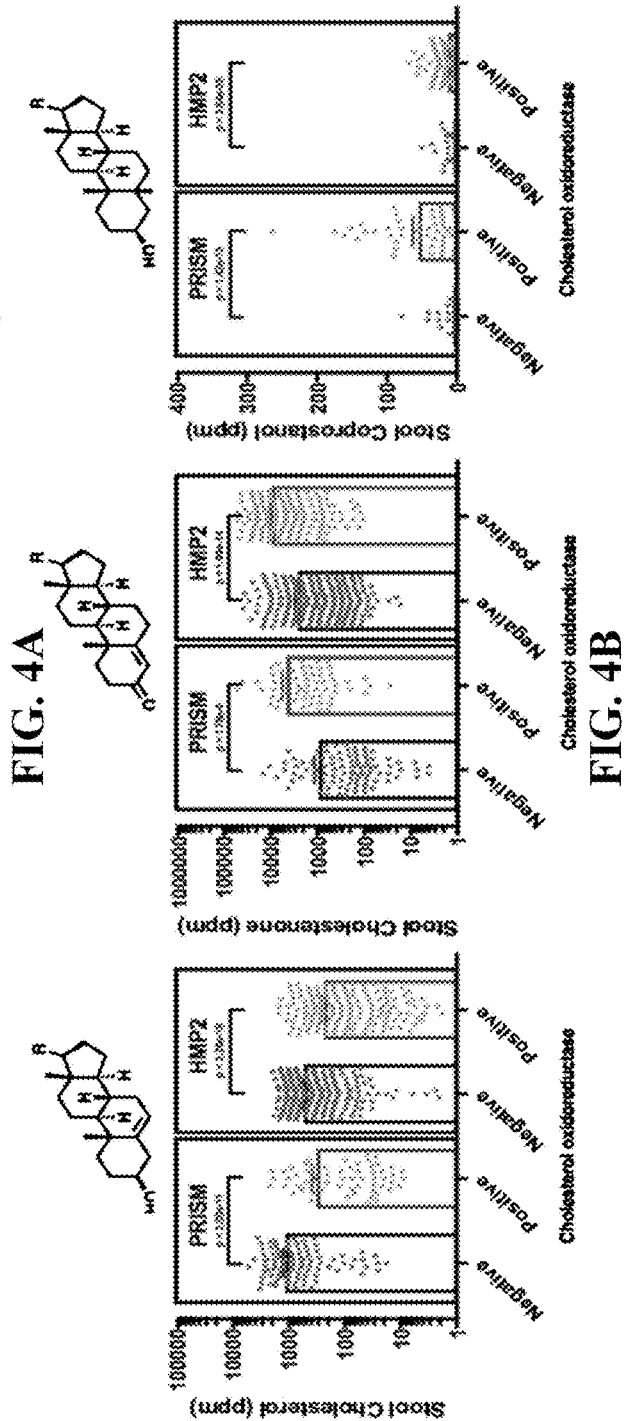
Figure 4C:
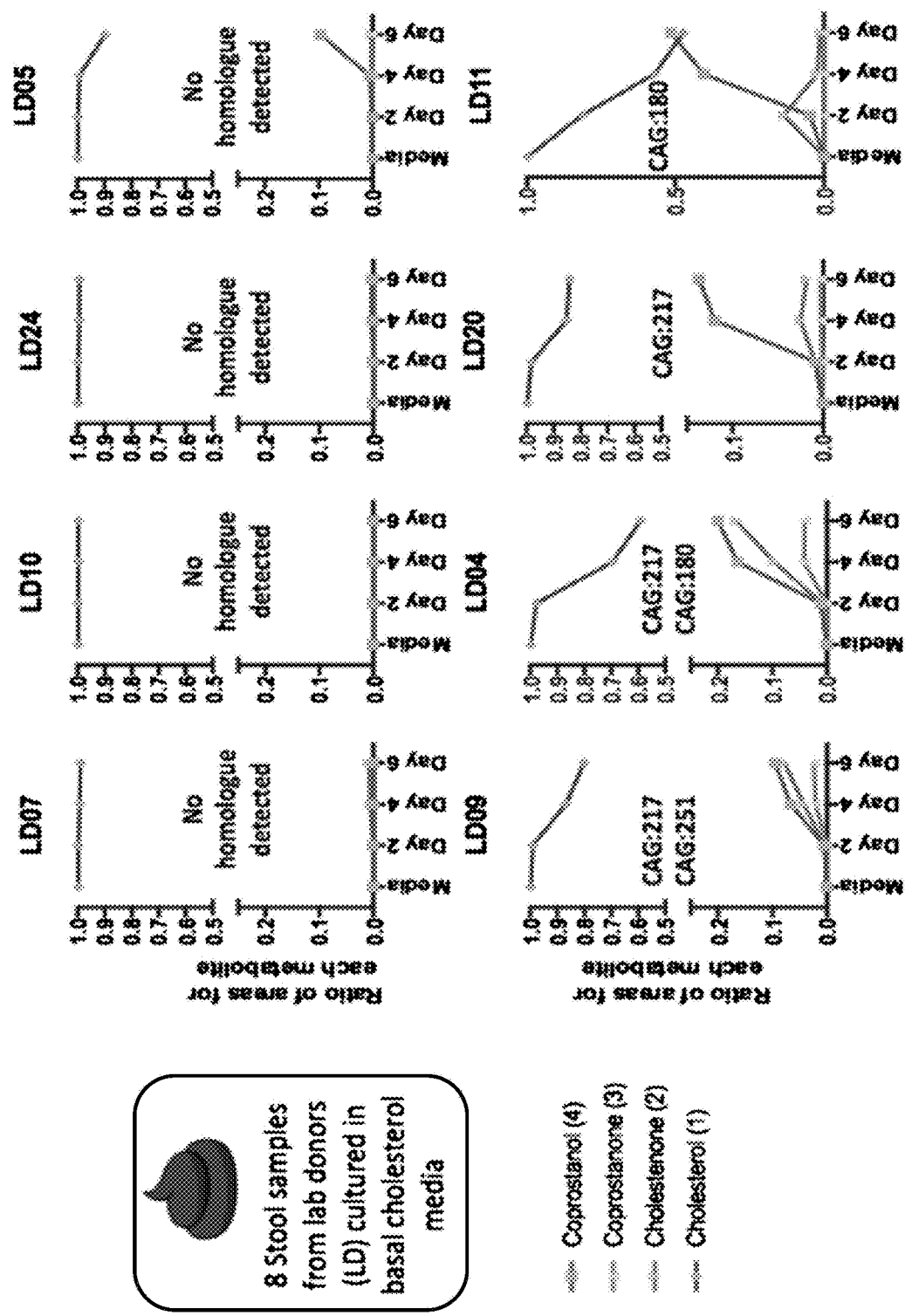
Figure 23B:
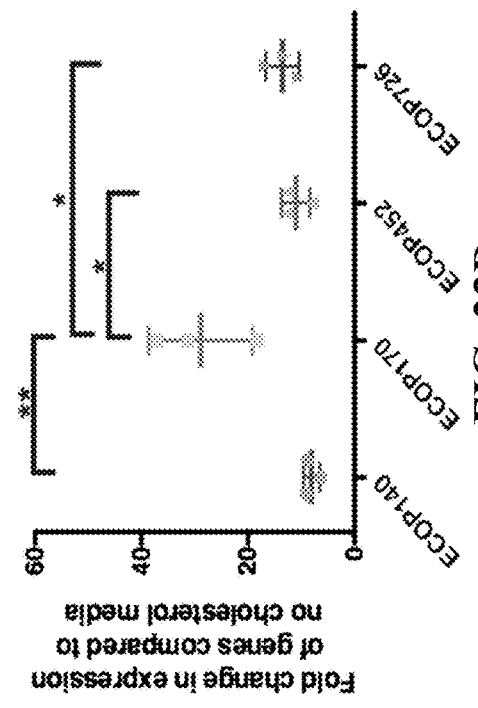
FIG. 23A-23D Cholesterol metabolism by *Eubacterium coprostanoligenes* in pure culture and lysates.
Figure 23D:
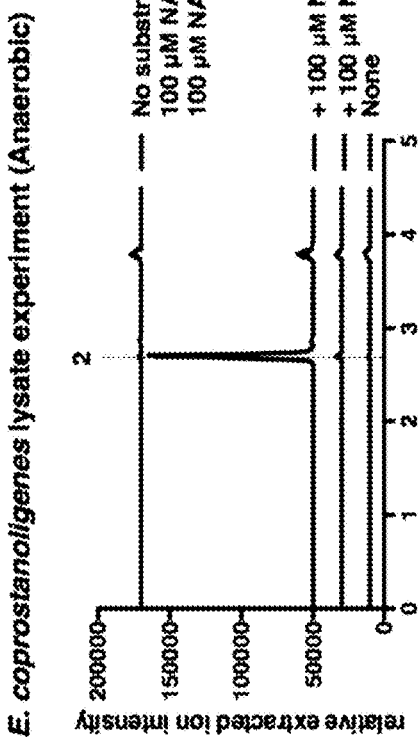
Figure 23A:
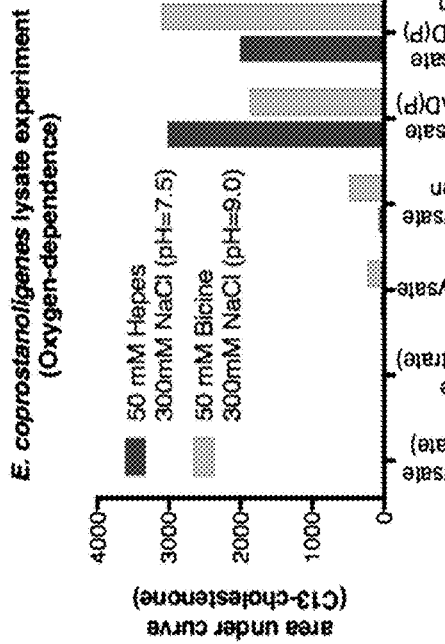

Since none of the bacterial isolates Applicants tested were able to complete this reaction, and since there are no available human gut bacterial isolates possessing cor genes, Applicants cultured stool samples from eight healthy donors in cholesterol-containing medium in order to study coprostanol-forming bacteria in mixed communities as a proxy for the gut microbiome (FIG. 4C). Metagenomic sequencing of the cultures was performed on day 3 and levels of cholesterol, 2, 3 and 4 were measured on days 2, 4, and 6. In four of the five cultures, cor homologs could be detected at day 3 and coprostanol was produced on day 6, further connecting the presence of these genes in gut microbial communities with cholesterol metabolism. Interestingly, while complete conversion of cholesterol to coprostanol was never observed, similar levels of coprostanol formation was observed in the stool cultures as in pure cultures of *E. coprostanoligenes*, suggesting there may be a limit to this metabolic transformation under these conditions (FIG. 23A).

Applicants next used paired metagenomic and metabolomic data from the HMP2 and PRISM cohorts to associate the presence of putative cor genes with fecal coprostanol levels. Applicants stratified patients as either coprostanol positive (converters) or coprostanol negative (non-converters), as determined by untargeted metabolomics of the fecal sample (see methods for details).31,32 In both cohorts, converter samples were strongly enriched in homologs of cholesterol oxidoreductase compared to non-converters (PRISM: OR=14.37 (95% CI: 5.41, 44.02); HMP2: OR=40.87 (95% CI: 18.02, 92.72)) (FIG. 4A, Table 10). This supports the hypothesis that the presence of a cor gene within a gut microbiome is predictive of coprostanol formation in the gut. Indeed, the presence of any of the 25 cor homologs was highly associated with the presence of coprostanol in the majority of samples. Applicants were not able to account for the remaining activity in ~⅓ of the samples, possibly due to the limitations of metagenomic sequencing.

Because the cor genes predict coprostanol formation from cholesterol, Applicants asked whether these genes could also predict variation in serum lipid levels, specifically HDL-C, LDL-C, and Total Cholesterol (TC). Applicants analyzed three studies (FHS, CVON, JIE et al), comprised of subjects from three countries (USA, Netherlands, China) with paired stool metagenomics and serum cholesterol measurements (Table 12). Given the key effects of these lipids on cardiovascular disease (CVD), the chosen studies also included participants with CVD. Subjects with any of the newly identified cor genes in their microbiome were classified as encoders, while those without the genes were considered

TABLE 10

Odds ratios for the presences of a cor genes and fecal coprostanol

| Predictor | Cohort | Outcome | n | n_unique | beta | lci | uci | p |
|---|---|---|---|---|---|---|---|---|
| Ecop_Homololgs_yes_no | HMP2 | dih. Coprostanol | 456 | 105 | 40.8732689 | 18.0173686 | 92.7229799 | 6.7918E−19 |
| Ecop_Homololgs_yes_no | PRISM | dih. Coprostanol | 151 | 151 | 14.3715211 | 5.40675844 | 44.0168803 | 4.5869E−07 |

Figure 21:
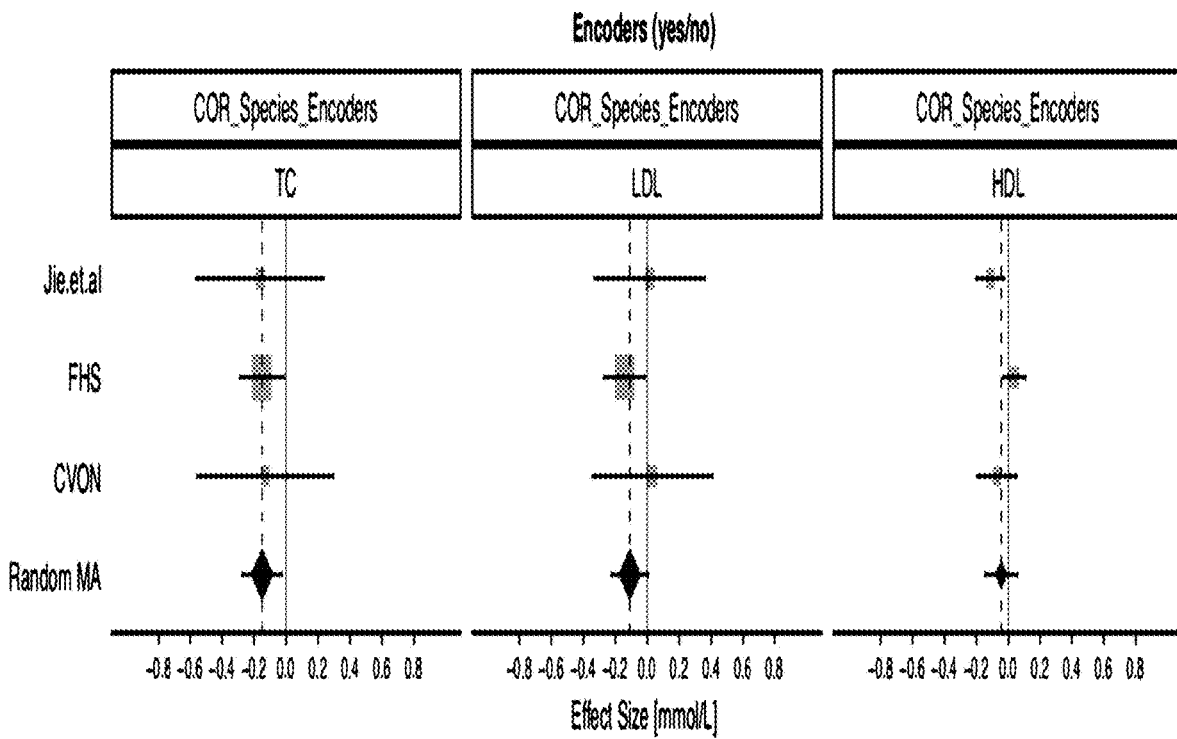
FIG. 21 Meta-analysis reveals an association of total cholesterol levels with encoder status in CVD cohorts. Three studies were included in random effects meta-analysis (highlighted in orange and annotated on y-axis). The changes in HDL-C, LDL-C, and total cholesterol (TC) levels (mmol/L) between encoders and non-encoders are represented for each study by the center of the square (95% confidence interval presented by respective horizontal black lines). The combined results of the meta-analysis is represented by blue diamonds with point estimate presented by vertical diamond points and dashed line, while respective 95% CI is presented by horizontal line in the diamond's center. Solid black line represents the null effect. Studies on the right of this line (i.e. positive values on the x axis) have a higher level of serum lipids in encoders compared to non-encoders; studies on the left (i.e. negative values on the x axis) have lower levels of serum lipids in encoders compared to non-encoders. In a meta-analysis of three studies, Applicants observed 0.15 mmol/L lower level of TC in encoders compared to non-encoders (95% CI: −0.27, −0.03) and 0.055 units for TG on log 10 scale lower levels in encoders compared to non-encoders (95% CI: −0.083, −0.027). Meta-analysis results for HDL-C and LDL-C were not statistically significant. Full results are presented in Table S12.

Applicants then evaluated whether the presence of cor genes was also associated with changes in fecal cholesterol and other pathway intermediates. Strikingly, Applicants observed a 69% and 60% reduction in stool cholesterol in encoders vs. non-encoders in the PRISM and HMP2 cohorts, respectively (FIG. 4B, Table S10), further data provided in Kenny et al., 2020 Cell Host & Microbe 28, 245-257, Table S5, specifically incorporated herein by reference. A corresponding increase in levels of stool cholestenone was also observed, with encoders having 4.8-fold increase and 2.3-fold increases in cholestenone compared to non-encoders (FIG. 4B, Table S10). These shifts in metabolite levels and their co-occurrence with the cor homologs suggests that cor+ bacteria affect the intestinal cholesterol pool.

non-encoders. In a meta-analysis of these studies, Applicants observed a pooled difference of −0.14 mmol/L in TC (95% CI: −0.27, −0.02) between encoders and non-encoders (FIG. 21, Table 13), with directional consistency across all three included studies and low between-study heterogeneity ($I^2=0$). Therefore, the presence of these gut bacterial genes significantly correlates with decreased serum cholesterol, suggesting that cholesterol metabolism by the human gut microbiota may impact host cholesterol levels. Due to the importance of triglycerides on CVD risk, Applicants also analyzed the effects of these bacteria on serum triglyceride levels. In a meta-analysis of the same studies above, Applicants observed a pooled difference of −0.056 log 10 (mmol/L) in log TG (95% CI: −0.083, −0.028) between converters and non-converters (FIG. 21, Table 13), with directional consistency across all three included studies and low between-study heterogeneity ($I^2=0$).

TABLE 11

Results from associations between all three fecal metabolites and encoder status for PRISM and HMP2

| Predictor | Cohort | Outcome | n | n_unique | beta | se | p |
|---|---|---|---|---|---|---|---|
| Ecop_Homololgs_yes_no | HMP2 | z.Cholesterol | 456 | 105 | −0.6703954 | 0.0839105 | 1.9948E−14 |
| Ecop_Homololgs_yes_no | HMP2 | z.Cholestenone | 456 | 105 | 0.86845121 | 0.09088552 | 2.2647E−19 |
| Ecop_Homololgs_yes_no | HMP2 | z.Coprostanol | 456 | 105 | 1.21811346 | 0.0832156 | 3.6373E−38 |
| Ecop_Homololgs_yes_no | PRISM | z.Cholesterol | 151 | 151 | −1.0959768 | 0.15055762 | 2.0019E−11 |
| Ecop_Homololgs_yes_no | PRISM | z.Cholestenone | 151 | 151 | 0.76692993 | 0.15393708 | 1.7775E−06 |
| Ecop_Homololgs_yes_no | PRISM | z.Coprostanol | 151 | 151 | 1.08335268 | 0.13257077 | 1.4185E−13 |

Note:
Results include longitudinally of the data for HMP2

TABLE 12

Summary statistics for the three human CVD cohorts used in this study

| Study | n | mean.Age | n.Females | mean.LDL | sd.LDL | mean.HDL |
|---|---|---|---|---|---|---|
| CVON | 282 | 66.9432624 | 125 | 4.1512766 | 0.96789705 | 1.33929078 |
| FHS | 624 | 55.6538462 | 343 | 3.07704597 | 0.82996651 | 1.59506309 |
| Jie.et.al | 193 | 60.7506423 | 193 | 2.63432642 | 0.98302474 | 0.98017617 |

| Study | sd.HDL | mean.TC | sd.TC | mean.TG |
|---|---|---|---|---|
| CVON | 0.31339638 | 6.27684397 | 1.11296163 | 1.7470922 |
| FHS | 0.50320333 | 4.91167041 | 0.92232909 | 1.19780675 |
| Jie.et.al | 0.26303394 | 4.39440415 | 1.17600479 | 1.66419689 |

| Study | sd.TG | n.CVD | n.Antibiotics_Use | n.Statin | mean.LDL.nonCVD | sd.LDL.nonCVD |
|---|---|---|---|---|---|---|
| CVON | 0.71984977 | 81 | 5 | 70 | 4.03427861 | 0.85482314 |
| FHS | 0.75173548 | 50 | 21 | 147 | 3.09704822 | 0.8191182 |
| Jie.et.al | 1.01905568 | 193 | 0 | 23 | #N/A | #N/A |

| Study | mean.HDL.nonCVD | sd.HDL.nonCVD | mean.TC.nonCVD | sd.TC.nonCVD |
|---|---|---|---|---|
| CVON | 1.3540796 | 0.31239762 | 6.14199005 | 1.01170451 |
| FHS | 1.60844599 | 0.50653924 | 4.94206765 | 0.90895134 |
| Jie.et.al | #N/A | #N/A | #N/A | #N/A |

| Study | mean.TG.nonCVD | sd.TG.nonCVD | mean.LDL.CVD | sd.LDL.CVD | mean.HDL.CVD | sd.HDL.CVD |
|---|---|---|---|---|---|---|
| CVON | 1.67437811 | 0.68508812 | 4.44160494 | 1.15933327 | 1.30259259 | 0.3147927 |
| FHS | 1.18286723 | 0.7425763 | 2.84742017 | 0.92391154 | 1.44142746 | 0.43909884 |
| Jie.et.al | #N/A | #N/A | 2.63432642 | 0.98302474 | 0.98017617 | 0.26303394 |

| Study | mean.TC.CVD | sd.TC.CVD | mean.TG.CVD | sd.TG.CVD |
|---|---|---|---|---|
| CVON | 6.61148148 | 1.27786454 | 1.92753086 | 0.77492343 |
| FHS | 4.56271011 | 1.00967872 | 1.36931241 | 0.83908306 |
| Jie.et.al | 4.39440415 | 1.17600479 | 1.66419689 | 1.01905568 |

Given well known downstream effects of lipid levels on CVD, Applicants also tested for interactions between cor presence and CVD status on lipid levels and found that they were not significant indicating that these effects are independent of CVD, although our meta-analysis is underpowered to answer this particular question (Table S12).

TABLE 13

Results from the meta-analysis using three CVD cohorts

| Homolog Status | Lipid | Study | n | beta | se | lower 95% CI | upper 95% CI | pval | Isq | increment | se.increment | p.increment |
|---|---|---|---|---|---|---|---|---|---|---|---|---|
| Encoders (YES/NO) | TC | CVON | 287 | -0.1302258 | 0.2172561 | -0.55604 | 0.2955883 | 0.5488984 | #N/A | 0.18122 | 0.6248885 | 0.77202881 |
| Encoders (YES/NO) | TC | FHS | 624 | -0.1428738 | 0.0703706 | -0.2807977 | -0.00494993 | 0.0423256 | #N/A | -0.152569 | 0.2558898 | 0.551241107 |
| Encoders (YES/NO) | TC | Jie.et.al | 193 | -0.1570342 | 0.1899963 | -0.5294202 | 0.21535176 | 0.4085138 | #N/A | #N/A | #N/A | #N/A |
| Encoders (YES/NO) | TC | Random MA | #N/A | -0.1433694 | 0.0631414 | -0.2671242 | -0.01961464 | 0.0231706 | 0 | #N/A | #N/A | #N/A |
| Encoders (YES/NO) | LDL | CVON | 282 | 0.0314318 | 0.1919074 | -0.3446999 | 0.40756337 | 0.8698996 | #N/A | -0.0809768 | 0.5542878 | 0.883956544 |
| Encoders (YES/NO) | LDL | FHS | 624 | -0.1438527 | 0.0657632 | -0.2727462 | -0.01495913 | 0.0287109 | #N/A | -0.0242922 | 0.2392459 | 0.91915772 |
| Encoders (YES/NO) | LDL | Jie.et.al | 193 | 0.0050764 | 0.1645217 | -0.3173802 | 0.32753303 | 0.9753847 | #N/A | #N/A | #N/A | #N/A |
| Encoders (YES/NO) | LDL | Random MA | #N/A | -0.1091054 | 0.0581905 | -0.2231566 | 0.00494584 | 0.0607968 | 0 | #N/A | #N/A | #N/A |
| Encoders (YES/NO) | HDL | CVON | 287 | -0.0735179 | 0.0638232 | -0.1986092 | 0.05157337 | 0.2493628 | #N/A | -0.3222581 | 0.1852082 | 0.082965617 |
| Encoders (YES/NO) | HDL | FHS | 624 | 0.0479746 | 0.0363993 | -0.0233668 | 0.11931596 | 0.1875012 | #N/A | -0.0586949 | 0.1324806 | 0.657888422 |
| Encoders (YES/NO) | HDL | Jie.et.al | 193 | -0.0871 | 0.041612 | -0.1686581 | -0.00554192 | 0.0363362 | #N/A | #N/A | #N/A | #N/A |
| Encoders (YES/NO) | HDL | Random MA | #N/A | -0.0322467 | 0.0488153 | -0.1279231 | 0.06342957 | 0.5088776 | 0.7054735 | #N/A | #N/A | #N/A |
| Encoders (YES/NO) | log.TG | CVON | 287 | -0.048546 | 0.0391992 | -0.1253749 | 0.02828296 | 0.2155513 | #N/A | 0.3257968 | 0.1111156 | 0.003646369 |
| Encoders (YES/NO) | log.TG | FHS | 624 | -0.0626904 | 0.0167236 | -0.095468 | -0.02991275 | 0.0001778 | #N/A | -0.0773037 | 0.0608041 | 0.204082165 |
| Encoders (YES/NO) | log.TG | Jie.et.al | 193 | -0.0273738 | 0.036468 | -0.0988499 | 0.04410223 | 0.4528785 | #N/A | #N/A | #N/A | #N/A |
| Encoders (YES/NO) | log.TG | Random MA | #N/A | -0.055507 | 0.014173 | -0.0832856 | -0.02772849 | 8.988E-05 | 0 | #N/A | #N/A | #N/A |

Note:
Increment tests for interactions between cor presence and CVD status on lipid levels

TABLE 14

Results from the meta-analysis using three CVD cohorts

| Homolog Status | Lipid | Study | n | Isq | increment | se.increment | p.increment |
|---|---|---|---|---|---|---|---|
| Encoders (YES/NO) | TC | CVON | 287 | #N/A | 0.181219998 | 0.624888537 | 0.77202881 |
| Encoders (YES/NO) | TC | FHS | 624 | #N/A | −0.152568966 | 0.255889767 | 0.551241107 |
| Encoders (YES/NO) | TC | Jie.et.al | 193 | #N/A | #N/A | #N/A | #N/A |
| Encoders (YES/NO) | TC | Random MA | #N/A | 0 | #N/A | #N/A | #N/A |
| Encoders (YES/NO) | LDL | CVON | 282 | #N/A | −0.08097676 | 0.5542878 | 0.883956544 |
| Encoders (YES/NO) | LDL | FHS | 624 | #N/A | −0.02429216 | 0.239245875 | 0.91915772 |
| Encoders (YES/NO) | LDL | Jie.et.al | 193 | #N/A | #N/A | #N/A | #N/A |
| Encoders (YES/NO) | LDL | Random MA | #N/A | 0 | #N/A | #N/A | #N/A |
| Encoders (YES/NO) | HDL | CVON | 287 | #N/A | −0.322258099 | 0.185208177 | 0.082965617 |
| Encoders (YES/NO) | HDL | FHS | 624 | #N/A | −0.058694932 | 0.132480619 | 0.657888422 |
| Encoders (YES/NO) | HDL | Jie.et.al | 193 | #N/A | #N/A | #N/A | #N/A |
| Encoders (YES/NO) | HDL | Random MA | #N/A | 0.705473531 | #N/A | #N/A | #N/A |
| Encoders (YES/NO) | log.TG | CVON | 287 | #N/A | 0.325796812 | 0.111115562 | 0.003646369 |
| Encoders (YES/NO) | log.TG | FHS | 624 | #N/A | −0.077303653 | 0.060804138 | 0.204082165 |
| Encoders (YES/NO) | log.TG | Jie.et.al | 193 | #N/A | #N/A | #N/A | #N/A |
| Encoders (YES/NO) | log.TG | Random MA | #N/A | 0 | #N/A | #N/A | #N/A |

DISCUSSION

There have been multiple proposed roles for the gut microbiota in affecting host cholesterol homeostasis.[33] Here, Applicants studied how direct gut microbial metabolism of cholesterol to coprostanol correlates with host serum cholesterol. Applicants have identified a family of genes in uncultured Clostridia species involved in cholesterol metabolism in human samples and showed that these genes encode functional enzymes that oxidize cholesterol to cholestenone, an on-pathway intermediate in coprostanol formation. The presence of cor genes in fecal metagenomic data correlated with higher stool coprostanol levels and lower stool cholesterol and serum TC and triglycerides. Thus, these gut bacterial enzymes may play an important role in human health. It is coincidental that the identification of microbes with the capacity to reduce cholesterol was within 20 years of the inception of the Framingham Heart Study, however over 70 years passed before Applicants could couple metagenomic and serum cholesterol data allowing us to draw the link between specific microbial genes and serum lipid levels.

All the cor genes described in this study come from reference-free metagenomic assemblies, and were identified in humans from geographically diverse locations. Applicants characterized the enzymes by expression in E. coli as a heterologous host, allowing circumvention of a lack of representative cultured species. Studying the metabolic potential of uncultured organisms by heterologously expressing genes of interest in tractable hosts is a powerful approach that will become increasingly important as computational methods continue to enable the discovery of microbes without cultured representatives. Many such species have been historically overlooked in analyses due to limitations of reference-based microbiome analyses.[25,34] This work indicates these gut microbes are untapped sources of biologically relevant metabolic transformations.

Depletion of intestinal cholesterol levels through cholesterol oxidoreductase activity may directly alter serum cholesterol by reducing intestinal cholesterol transport. To put the magnitude of the observed effects into perspective, such effect sizes of the cor genes (0.14 mmol/L for TC) are comparable with the largest effects of lipid-associated host genes, such as HMGCR (0.063 SD units per allele for TC, which would correspond to 0.058 mmol/L for FHS study (see methods for details)), or PCSK9 (0.054 SD units per allele for TC, which would correspond to 0.050 mmol/L per allele for TC for FHS study).[35] Given that natural genetic variation differences in human genes were comparable in magnitude to microbial cor gene-dependent differences, and that modulating human genes with appropriate targeted therapeutics produce larger effect sizes (statins targeting HMGCR: on average 1.20 mmol/L on TC)[36], it is also possible that similar effect sizes on host lipids may be expected from targeting this microbial pathway. Furthermore, the association of the cor genes with lower serum triglycerides (corresponding to lower TG for encoders) also supports their role as potentially protective in CVD, although current cohorts are underpowered to assess CVD risk based on microbiome composition, which would most likely require large-scale prospective studies.

In addition, the effects of coprostanol on intestinal cholesterol absorption merit further investigation. Dietary intake of a diverse number of sterols and stanols can influence intestinal absorption of cholesterol. Since almost nothing is known about the effects of coprostanol on the host, the use of human cohorts may also lead to the discovery of novel coprostanol biology. More generally, linking gut microbial activities to organisms, genes and enzymes is a critical component of studying metabolic interactions with the human host. In the future, manipulation of cholesterol levels through gut microbiota-based interventions may become a viable therapeutic strategy for decreasing serum cholesterol levels.

Methods:

Materials, General Methods and Instrumentation.

E. coprostanoligenes ATCC51222 was obtained from the American Type Culture Collection. E. coprostanoligenes and stool cultures were grown in basal cholesterol medium (BCM), which contained (per liter) 10 g of casitone (Difco Laboratories, Detroit, Mich.), 10 g of yeast extract, 2 g of cholesterol, 1 g of lecithin, 0.5 g of sodium thioglycolate, 1 g of calcium chloride dihydrate, and 1 mg of resazurin. E. coprostanoligenes was grown on YCFA plates, which contained (per liter) 10 g of casitone, 2.5 g of yeast extract, 5 g of glucose, 45 mg of $MgSO_4 \times 7H_2O$, 90 mg of $CaCl_2) \times 2H_2O$, 0.45 g of $K_2HPO_4$, 0.45 g of $KH_2PO_4$, 0.9 g of NaCl, 1.0 mg of resazurin and 15 g of technical agar (Difco). The solution was autoclaved, cooled to room temperature, and then 10 mL of BBL™ Vitamin K1-Hemin Solution (BD Biosciences), 4 g of $NaHCO_3$, 1 g of L-cysteine-HCl, and 1 mL of Volatile Fatty Acids (VFA) solution were added. VFA solution was made up of 1.90 mL of acetic acid, 0.70 mL of propionic acid, 90 μL of iso-butyric acid, and 100 μL of iso-valeric acid.

Cultures were grown and handled in an anaerobic chamber (Coy Laboratory Products) with an atmosphere of 20% $CO_2$, 5% $H_2$, and 75% $N_2$ at 37° C. Cloning and expression of candidate cholesterol oxidoreductase genes.

Candidate cholesterol oxidoreductase genes were amplified from genomic DNA (for E. coprostanoligenes) and cloned into pET28b. DNA was extracted from stool samples (DNeasy PowerSoil Kit, Qiagen) (for CAG:217, CAG:251 and CAG:341) or purchased from Genewiz (Ordered sequences are listed in Table 6). PCR reactions were performed with Phusion High Fidelity polymerase, and PCR products were purified (Zymoclean gel DNA recovery kit, Zymo research). The resulting gene products were assembled into pET28b using Gibson assembly and transformed into Stellar™ Competent Cells. The identities of the constructs were confirmed with DNA sequencing and transformed into E. coli BL21 strains for expression. All constructs were grown in LB with kanamycin (50 μg/mL) with the exception of the strain expressing the homolog from CAG:180 which required growth in TB for protein expression. All constructs were induced at an $OD_{600}$ of 0.5-0.6 with 500 μM isopropyl β-D-1-thiogalactopyranoside, and the induced cells were incubated at 20° C. for 20 h.

Lysate Experiments for Cholesterol Oxidoreductase Activity 500 mL of a culture of E. coli BL21 expressing one of the cholesterol oxidoreductase homologs were pelleted by centrifugation (20 min at 7,000 g and 4° C.), resuspended in 10 mL of ice-cold phosphate-buffered saline containing one cOmplete Protease Inhibitor cocktail tablet (Roche Diagnostics) and lysed by a cell disruptor (EmulsiFlex-C3, Avestin). Cell debris was removed by ultracentrifugation (30 min at 20,000 g and 4° C.). Protein expression was confirmed by SDS-PAGE analysis using 4-20% Mini-PROTEAN TGX gels (Bio-Rad Laboratories). Gels were stained with Coomassie Blue for visualization. The clarified supernatant was used directly in the cell lysate assay described below. Cholesterol or coprostanol (5 μL of a 10 mM solution of cholesterol or coprostanol in methanol) was added to 500 μL of clarified supernatant with 100 μM of $NADP^+$ and $NAD^+$. After incubation at 37° C. for 12 h, the reaction mixtures were frozen until being analyzed using LC-MS.

qPCR of E. coprostanoligenes

Total RNA was purified by chloroform-phenol extraction from cell pellets of replicate cultures of E. coprostanoligenes grown in basal cholesterol media for 48 h. RNA was DNase treated, and cDNA was prepared using the High-Capacity cDNA Reverse Transcription Kit (Applied Biosystems) with or without reverse transcriptase. Transcripts of interest were quantified by real-time PCR carried out using iTaq Universal SYBR Green Supermix (Bio-Rad). All qPCRs were normalized to 16S rRNA gene expression. Primers used are listed in Table 5.

Purification of N-his Terminal Tagged ECOP170

Proteins were overexpressed using the procedure described above. Cells from 200 mL of culture were pelleted by centrifugation, resuspended in 10 mL of ice-cold lysis buffer (300 mM NaCl, 10 mM imidazole, 50 mM HEPES, pH 7.5) containing one cOmplete Protease Inhibitor cocktail tablet, and lysed by 4 min of continuous passage through a cell disruptor (EmulsiFlex-C3, Avestin) at 15,000 lbs per square inch. Cell debris was removed by ultracentrifugation (20 min at 20,000×g and 4° C.), and the cell-free extract was applied to 0.5 mL of HisPur Ni-NTA Resin (Thermo Scientific) pre-equilibrated with lysis buffer by gentle rocking at 4° C. for 2 h. Non-absorbed materials and weakly bound proteins were removed by washing the column with 2×25 mL of wash buffer (300 mM NaCl, 20 mM imidazole, 50 mM HEPES, pH 7.5). His6-tagged protein was eluted with 5 mL of elution buffer (300 mM NaCl, 200 mM imidazole, 50 mM HEPES, pH 7.5). After SDS-PAGE analysis, eluent containing pure protein was dialyzed (Spectra/Por Dialysis Membrane, 6-8 kDa molecular weight cutoff; Spectrum Labs) against 500 mL of extraction buffer (300 mM NaCl, 50 mM HEPES, pH 7.5) for 12 h at 4° C. The proteins were immediately used in enzymatic assays.

Culturing Stool Samples

Approximately 100 mg of frozen stool sample was suspended in 20 mL of pre-reduced PBS and vortexed for homogenization. 500 μL of stool slurry was added to 5 mL of pre-reduced basal cholesterol media and cultured in an anaerobic chamber at 37° C.

Extraction of Cholesterol, Cholestenone, Coprostanone and Coprostanol

Samples (either stool cultures, reaction mixtures with purified enzymes or lysates) were diluted 1:10 in methanol. Insoluble debris was removed by centrifugation (10 min at 5,000×g and 4° C.) and the supernatant was injected onto a Kinetex 2.6 μm, C8 100 Å 100×3 mm (Phenomenex) column for LC-MS analysis.

Instrumentation and Chromatographic Conditions for Measurement of Sterols

Analysis of the sterols in samples was performed using an ultra-high performance liquid chromatography tandem mass spectrometry (UHPLC-MS/MS) system model Xevo TQ-S (Waters). The mass spectrometer system consists of a triple quadrupole equipped with an atmospheric pressure chemical ionization (APCI) probe. The chromatographic separation was performed on a Kinetex 2.6 μm, C8 100 Å 100×3 mm (Phenomenex) column. The LC elution method was as follows: 0-4.5 min (93% B) at a flow rate of 0.5 mL/min at 40° C. Solvent A was water with 0.1% formic acid, and solvent B was acetonitrile with 0.1% formic acid.

To measure cholesterol, cholestenone, coprostanone and coprostanol, the retention times and mass transitions listed below were monitored for each compound: cholesterol (rt 2.70, 369.332→147.021), cholestenone (rt 2.60, 385.244→108.988), coprostanone (rt 3.00, 369.332→147.021), coprostanol (rt 3.20, 371.304→95.011).

Extraction of DNA and Metagenomic Sequencing of Human Stool Samples

For samples used in FIG. 4C, 1 mL of stool culture (described above) at day 3 was centrifuged at 5,000×g for 10 min. Supernatant was removed and the pellet was frozen until further processing. DNeasy PowerSoil Kit was used to isolate DNA (Qiagen).

For Framingham Heart Study (FHS) samples, stool was collected in 100% ethanol for nucleic acid extraction as previously described.[32] For DNA extraction, a combination of the QIAamp 96 PowerFecal Qiacube HT Kit (Qiagen Cat No./ID: 51531), the Allprep DNA/RNA 96 Kit (Qiagen Cat No./ID: 80311), and IRS solution (Qiagen Cat No./ID: 26000-50-2) kits were used with a custom protocol as previously described.[37] Briefly, approximately 100 mg of stool were transferred into individual wells of the Power-Bead plate, with 0.1 mm glass beads (Cat No./ID: 27500-4-EP-BP) prior to bead beating on a TissueLyzer II at 20 Hz for a total of 10 minutes. Samples were transferred into AllPrep 96 DNA plate and processed as per manufacturer's instructions. Purified DNA was stored at −20° C.

For metagenomic library construction, DNA samples were first quantified by Quant-iT PicoGreen dsDNA Assay (Life Technologies) and normalized to a concentration of 50 pg/μL. Illumina sequencing libraries were prepared from 100-250 pg of DNA using the Nextera XT DNA Library Preparation kit (Illumina) according to the manufacturer's recommended protocol, with reaction volumes scaled accordingly. Prior to sequencing, libraries were pooled by collecting equal volumes (200 nL) of each library from batches of 96 samples. Insert sizes and concentrations for each pooled library were determined using an Agilent Bioanalyzer DNA 1000 kit (Agilent Technologies). Libraries were sequenced on HiSeq 2500 2×101 to yield ~10 million paired end reads per sample. De-multiplexing and BAM and FASTQ file generation were performed using the Picard suite (https://broadinstitute.github.io/picard).

Untargeted Metabolomics of Fecal Samples

Cholesterol (rt 7.21, m/z 369.3519), cholestanone (rt 7.00, m/z 385.3465), and coprostanol (rt 7.50, m/z 371.3583) could be identified in published metabolomics datasets (PRISM and HMP2).

Computational Methods

Raw sequencing data for PRISM31, HMP232, CVON38, 500FG39 and a study by Jie et al 40 were downloaded from SRA: PRJNA400072 (PRISM), PRJNA398089 (HMP2), PRJNA319574 (500FG), or from EBI: EGAS00001003508 (CVON), PRJEB21528 (study by Jie et al).

The quality control for all metagenomic datasets was conducted using Trim Galore! to detect and remove sequencing adapters (minimum overlap of 5 bp) and kneadData v0.7.2 to remove human DNA contamination and trim low-quality sequences (HEADCROP:15 SLIDING-WINDOW:1:20), retaining reads that were at least 50 bp long.

Applicants employed a two-step approach to analyze metagenomic data: 1) assembly and metagenomic species binning across all datasets to search for homologs of the prioritized cholesterol oxidoreductase from *E. coprostanoligenes* and 2) targeted assembly across prioritized samples to create draft genomes for human gut microbes that encode the homologs to the prioritized cholesterol oxidoreductase from *E. coprostanoligenes*. In step 1, metagenomic reads were assembled individually for each sample into contigs using MegaHIT[41], followed by an open reading frame prediction with Prodigal[42] and retaining only full length genes (containing both start and stop codon). A non-redundant gene catalogue was constructed by clustering predicted genes based on sequence similarity at 95% identity and 90% coverage of the shorter sequence using CD-HIT.[43,44] Reads were mapped to the gene catalogue with BWA[45], filtered to include strong mappings with at least 95% sequence identity over the length of the read, counted (count matrix) and normalized to transcript-per-million (TPM matrix). Count matrix served as an input for binning genes into metagenomic species pan-genomes (core and accessory genes) using MSPminer with default settings[26]. Applicants annotated the gene catalogue at species, genus and phylum levels with NCBI RefSeq (version May 2018) as described previously[46]. To annotate phylogenetically MSPs that had no match to any species from NCBI RefSeq Applicants used Phylophlan with default settings[27]. In step 2, for the prioritized MSPs Applicants selected 35 human gut microbiomes (at least two per MSP) that had the highest cumulative read-per-kilobase (RPK) count across all MSP genes (counted in step 1) for assembly with SPAdes[47] in '--meta' mode. Applicants also included the 4 cultured stool samples that showed cholesterol oxidoreductase activity. 6 samples were aborted after two assembly trials due to expected very long runtime (>>48 h), and in their case Applicants reverted to the MegaHIT assemblies from step 1. To construct the draft genomes Applicants used genes binned in the respective MSPs (from step 1) to find (min. 95% identity, min. 50% coverage, USEARCH ublast[48]) and extract contigs encoding them. Applicants evaluated the quality of the draft genomes using completeness and contamination measurements based on lineage specific marker genes with CheckM ('lineage_wf' workflow)[49]. As recommended by CheckM framework, draft genomes with >90% completeness and <5% contamination were considered as near complete with low contamination, i.e. of highest quality. All-vs-all genome-wide calculation of sequence identity for the draft genomes and the genome of *E. coprostanoligenes* was performed with FastANI[50]. To test for detection of *E. coprostanoligenes* in the human gut microbiome Applicants searched for its genes in the assembled gene catalogue (min. 95% identity, USEARCH global alignment[48]) or mapped metagenomic stool samples (as in step 1 above) to the assembled gene catalogue that was augmented with the *E. coprostanoligenes* genes (only added genes with less than 95% identity to other genes in the gene catalogue, USEARCH global alignment[48]). Additional details can be found in Kenny et al., 2020, Cholesterol Metabolism by Uncultured Human Gut Bacteria Influences Host Cholesterol Level, Cell Host & Microbe, 28, 245-247, incorporated herein by reference in its entirety. Specifically, Table S4 of Kenny et al. details the information generated from genomes in this study, comparison to previously published studies on metagenomic species, and results from commonly used microbiome analysis software, specifically incorporated herein by reference.

Associations with Blood Lipids and Meta-Analysis of Four Studies

Applicants studied the relationship between converter status and blood concentration of total cholesterol, LDL-C and HDL-C in three studies with publicly available shotgun metagenomic sequencing datasets: CVON[38], a study by Jie et al.[40] and one newly sequenced FHS study. Detailed characteristics of studies are provided in Table 12.

Converter status was coded both as a dichotomous variable (converter cases and controls (="non-converter")) and continuous z-scores for homolog TPM count produced in each study by subtracting the mean from each individual TPM count value and dividing by the standard deviation.

In each study Applicants performed association analysis using a generalized linear model with a given lipid as outcome (in mmol/L) and encoder status as a predictor. Age (in years), sex, antibiotic usage (yes/no) and statin usage (yes/no) were fitted as covariates while optimization was performed using lm function in R. CVD status (yes/no) was additionally included in the model in all studies with available data (CVON and FHS). All participants of the Jie et al. study were not taking antibiotics.[40] For the Jie et al. study, statin usage was not reported for controls and thus only CVD cases were used in our analyses to avoid confounding of associations due to profound effects of statins on lipid concentrations. In order to investigate potential incremental relationships between encoder and CVD status, Applicants performed a sensitivity analysis by fitting interaction between predictor and CVD in the model for all studies with available data (CVON and FHS). Results from this increment analysis are presented in Table 13.

Inverse variance-weighted random-effects meta-analysis implemented in meta R package was used to obtain pooled estimates for relationship between converter status and lipid concentrations across all four studies with between-study heterogeneity calculated using P statistics.[51]

Relationships Between Stool Metabolites and Converter Status

Relationships between stool metabolites and converter status were investigated in PRISM[31] and HMP2[32] studies. In PRISM and HMP2, data for cholesterol, cholestenone and coprostanol was available. Applicants performed log 10 transformation (with pseudo count of 1e-5 for zero values) of metabolite data followed by calculation of z-scores as described above. For coprostanol Applicants also created dichotomous variable indicating presence or absence of this metabolite in stool samples.

In PRISM, transformed rescaled values of metabolites were used as outcomes in linear regression models using lm function (stats package in R), converter status was included as predictor, while age, gender, antibiotic usage (yes/no) and disease status (nonIBD, CD or UC) were used as covariates. For dichotomous coprostanol variable Applicants utilized the same model specification, but applied logistic model using glm function (stats package in R). Results from this analysis are presented in Table 10 and 11.

Given that in the HMP2 study longitudinal metabolite measurements were available, Applicants utilized mixed effects models to study relationships between converter status and stool metabolite concentrations. Transformed metabolite values were fitted as outcomes and converter status was specified as predictor while subjects were included as random effects to account for correlation between repeated measures (line function from nlme R package). For dichotomous coprostanol variable Applicants fitted logistic mixed effects model including subjects as random effects variable (glmer function from lme4 package in R). Age, gender, antibiotic usage (yes/no) and disease status (nonIBD, CD or UC) were included in all models as covariates (fixed effects) in HMP2 study. Results from this analysis are presented in Table 10 and 11.

Effect Size of Serum Lipid Associated Genes in FHS Cohort

Effect size of each gene highlighted in the text was calculated in units of mmol/L from SD units reported in Willer et al.[35] Briefly, SD of lipid of interest from the FHS cohort (e.g., 0.922329093 mmol/L for TC) was multiplied by the effect size per allele in SD units (e.g., 0.068 in SD units for HMGCR) to give the effect size in mmol/L (e.g., 0.063 mmol/L per allele in FHS study for HMGCR).

Data Availability

PRISM and HMP2 metabolomics data (accession number PR000677 and PR000639 respectively) are available at the NIH Common Fund's Metabolomics Data Repository and Coordinating Center (supported by NIH grant, U01-DK097430): Metabolomics Workbench (http://www.metabolomicsworkbench.org).

The following references relate to Example 1, and are specifically incorporated herein by reference:

1. Goldstein, J. L. & Brown, M. S. A century of cholesterol and coronaries: from plaques to genes to statins. Cell 161, 161-172 (2015).
2. Bays, H. E., Neff, D., Tomassini, J. E. & Tershakovec, A. M. Ezetimibe: cholesterol lowering and beyond. Expert Rev. Cardiovasc. Ther. 6, 447-470 (2008).
3. Chiang, J. Y. L. Bile acids: regulation of synthesis. J. Lipid Res. 50, 1955-1966 (2009).
4. Fu, J. et al. The Gut Microbiome Contributes to a Substantial Proportion of the Variation in Blood Lipids. Circ. Res. 117, 817-824 (2015).
5. Rothschild, D. et al. Environment dominates over host genetics in shaping human gut microbiota. Nature 555, 210-215 (2018).
6. Park, S. et al. Cholesterol-lowering effect of *Lactobacillus rhamnosus* BFE5264 and its influence on the gut microbiome and propionate level in a murine model. PLoS One 13, e0203150 (2018).
7. Rosenfeld, B. Y. R. S., Fukushima, D. K., Hellman, L. & Gallagher, T. F. THE TRANSFORMATION OF CHOLESTEROL TO COPROSTANOL".
8. Sekimoto, H., Shimada, O., Makanishi, M., Nakano, T. & Katayama, O. Interrelationship between serum and fecal sterols. Jpn. J. Med. 22, 14-20 (1983).
9. Li, L., Batt, S. M., Wannemuehler, M., Dispirito, A. & Beitz, D. C. Effect of feeding of a cholesterol-reducing bacterium, *Eubacterium coprostanoligenes*, to germ-free mice. Lab. Anim. Sci. 48, 253-255 (1998).
10. Li, L., Buhman, K. K., Hartman, P. A. & Beitz, D. C. Hypocholesterolemic effect of *Eubacterium coprostanoligenes* ATCC 51222 in rabbits. Lett. Appl. Microbiol. 20, 137-140 (1995).
11. Eyssen, H. J., Parmentier, G. G., Compernolle, F. C., De Pauw, G. & Piessens-Denef, M. Biohydrogenation of sterols by *Eubacterium* ATCC 21,408—Nova species. Eur. J. Biochem. 36, 411-421 (1973).
12. Mott, G. E. & Brinkley, A. W. Plasmenylethanolamine: growth factor for cholesterol-reducing *Eubacterium*. J. Bacteriol. 139, 755-760 (1979).
13. Sadzikowski, M. R., Sperry, J. F. & Wilkins, T. D. Cholesterol-reducing bacterium from human feces. Appl. Environ. Microbiol. 34, 355-362 (1977).
14. Freier, T. A., Beitz, D. C., Li, L. & Hartman, P. A. Characterization of *Eubacterium coprostanoligenes* sp. nov., a cholesterol-reducing anaerobe. Int. J. Syst. Bacteriol. 44, 137-142 (1994).
15. Gerard, P. et al. *Bacteroides* sp. Strain D8, the First Cholesterol-Reducing Bacterium Isolated from Human Feces. Appl. Environ. Microbiol. 73, 5742-5749 (2007).
16. Lye, H.-S., Rusul, G. & Liong, M.-T. Removal of cholesterol by lactobacilli via incorporation and conversion to coprostanol. J. Dairy Sci. 93, 1383-1392 (2010).
17. Vatanen, T. et al. Genomic variation and strain-specific functional adaptation in the human gut microbiome during early life. Nat Microbiol 4, 470-479 (2019).

18. Norm, K. E., Persson, A. K., Saxerholt, H. & Midtvedt, T. Establishment of *Lactobacillus* and *Bifidobacterium* species in germfree mice and their influence on some microflora-associated characteristics. Appl. Environ. Microbiol. 57, 1850-1852 (1991).
19. Parmentier, G. & Eyssen, H. Mechanism of biohydrogenation of cholesterol to coprostanol by *Eubacterium* ATCC 21408. Biochim. Biophys. Acta 348, 279-284 (1974).
20. Ren, D., Li, L., Schwabacher, A. W., Young, J. W. & Beitz, D. C. Mechanism of cholesterol reduction to coprostanol by *Eubacterium coprostanoligenes* ATCC 51222. Steroids 61, 33-40 (1996).
21. Björkhem, I. & Gustafsson, J. A. Mechanism of microbial transformation of cholesterol into coprostanol. Eur. J. Biochem. 21, 428-432 (1971).
22. Kreit, J. & Sampson, N. S. Cholesterol oxidase: physiological functions. FEBS J. 276, 6844-6856 (2009).
23. Chiang, Y.-R. et al. Study of Anoxic and Oxic Cholesterol Metabolism by *Sterolibacterium denitrificans*. J. Bacteriol. 190, 905-914 (2008).
24. Devlin, A. S. & Fischbach, M. A. A biosynthetic pathway for a prominent class of microbiota-derived bile acids. Nat. Chem. Biol. 11, 685-690 (2015).
25. Nielsen, H. B. et al. Identification and assembly of genomes and genetic elements in complex metagenomic samples without using reference genomes. Nat. Biotechnol. 32, 822-828 (2014).
26. Plaza Oñate, F. et al. MSPminer: abundance-based reconstitution of microbial pan-genomes from shotgun metagenomic data. Bioinformatics (2018). doi:10.1093/bioinformatics/bty830
27. Segata, N., Börnigen, D., Morgan, X. C. & Huttenhower, C. PhyloPhlAn is a new method for improved phylogenetic and taxonomic placement of microbes. Nat. Commun. 4, 2304 (2013).
28. Lopetuso, L. R., Scaldaferri, F., Petito, V. & Gasbarrini, A. Commensal Clostridia: leading players in the maintenance of gut homeostasis. Gut Pathog. 5, 23 (2013).
29. Mallonee, D. H. & Hylemon, P. B. Sequencing and expression of a gene encoding a bile acid transporter from *Eubacterium* sp. strain VPI 12708. J. Bacteriol. 178, 7053-7058 (1996).
30. Warnke, M. et al. A patchwork pathway for oxygenase-independent degradation of side chain containing steroids. Environ. Microbiol. 19, 4684-4699 (2017).
31. Franzosa, E. A. et al. Gut microbiome structure and metabolic activity in inflammatory bowel disease. Nat Microbiol 4, 293-305 (2019).
32. Lloyd-Price, J. et al. Multi-omics of the gut microbial ecosystem in inflammatory bowel diseases. Nature 569, 655-662 (2019).
33. Ooi, L.-G. & Liong, M.-T. Cholesterol-lowering effects of probiotics and prebiotics: a review of in vivo and in vitro findings. Int. J. Mol. Sci. 11, 2499-2522 (2010).
34. Pasolli, E. et al. Extensive Unexplored Human Microbiome Diversity Revealed by Over 150,000 Genomes from Metagenomes Spanning Age, Geography, and Lifestyle. Cell 176, 649-662.e20 (2019).
35. Willer, C. J. et al. Discovery and refinement of loci associated with lipid levels. Nat. Genet. 45, 1274-1283 (2013).
36. Law, M. R., Wald, N. J. & Rudnicka, A. R. Quantifying effect of statins on low density lipoprotein cholesterol, ischaemic heart disease, and stroke: systematic review and meta-analysis. BMJ 326, 1423 (2003).
37. Lavoie, S. et al. The Crohn's disease polymorphism, ATG16L1 T300A, alters the gut microbiota and enhances the local Th1/Th17 response. Elife 8, (2019).
38. Kurilshikov, A. et al. Gut Microbial Associations to Plasma Metabolites Linked to Cardiovascular Phenotypes and Risk. Circ. Res. 124, 1808-1820 (2019).
39. Schirmer, M. et al. Linking the Human Gut Microbiome to Inflammatory Cytokine Production Capacity. Cell 167, 1125-1136.e8 (2016).
40. Jie, Z. et al. The gut microbiome in atherosclerotic cardiovascular disease. Nat. Commun. 8, 845 (2017).
41. Li, D., Liu, C.-M., Luo, R., Sadakane, K. & Lam, T.-W. MEGAHIT: An ultra-fast single-node solution for large and complex metagenomics assembly via succinct de Bruijn graph. Bioinformatics 31, 1674-1676 (2015).
42. Hyatt, D. et al. Prodigal: prokaryotic gene recognition and translation initiation site identification. BMC Bioinformatics 11, 119 (2010).
43. Fu, L., Niu, B., Zhu, Z., Wu, S. & Li, W. CD-HIT: accelerated for clustering the next-generation sequencing data. Bioinformatics 28, 3150-3152 (2012).
44. Qin, J. et al. A human gut microbial gene catalogue established by metagenomic sequencing. Nature 464, 59-65 (2010).
45. Li, H. & Durbin, R. Fast and accurate short read alignment with Burrows-Wheeler transform. Bioinformatics 25, 1754-1760 (2009).
46. Li, J. et al. An integrated catalog of reference genes in the human gut microbiome. Nat. Biotechnol. 32, 834-841 (2014).
47. Bankevich, A. et al. SPAdes: a new genome assembly algorithm and its applications to single-cell sequencing. J. Comput. Biol. 19, 455-477 (2012).
48. Edgar, R. C. Search and clustering orders of magnitude faster than BLAST. Bioinformatics 26, 2460-2461 (2010).
49. Parks, D. H., Imelfort, M., Skennerton, C. T., Hugenholtz, P. & Tyson, G. W. CheckM: assessing the quality of microbial genomes recovered from isolates, single cells, and metagenomes. Genome Res. 25, 1043-1055 (2015).
50. Jain, C., Rodriguez-R, L. M., Phillippy, A. M., Konstantinidis, K. T. & Aluru, S. High throughput ANI analysis of 90K prokaryotic genomes reveals clear species boundaries. Nat. Commun. 9, 5114 (2018).
51. Higgins, J. P. T. & Thompson, S. G. Quantifying heterogeneity in a meta-analysis. Stat. Med. 21, 1539-1558 (2002).

Example 2—Substrate Scope of CORs

Phytosterols are found in large quantities in plant-based foods. They also have cholesterol lowering effects according to the literature. However, it is not clear whether the reduced forms ($\Delta^{5,6}$) of these molecules (like coprostanol is the reduced form of cholesterol) are the active components. The presence of one of the presently disclosed COR containing microbes will predict whether a microbiome can form the reduced forms of these phytosterols. Without being bound by theory, it is believed that similar to coprostanol, administration of these reduced forms might work to lower serum cholesterol. Analogous to the reduction of the 5,6-double bond of cholesterol to coprostanol, the COR enzymes are involved in the reduction of the 5,6-double bond in beta-sitosterol, campesterol and stigmasterol.

Accordingly, in some instances, the COR enzymes as disclosed herein can utilize substrates according to the formula:

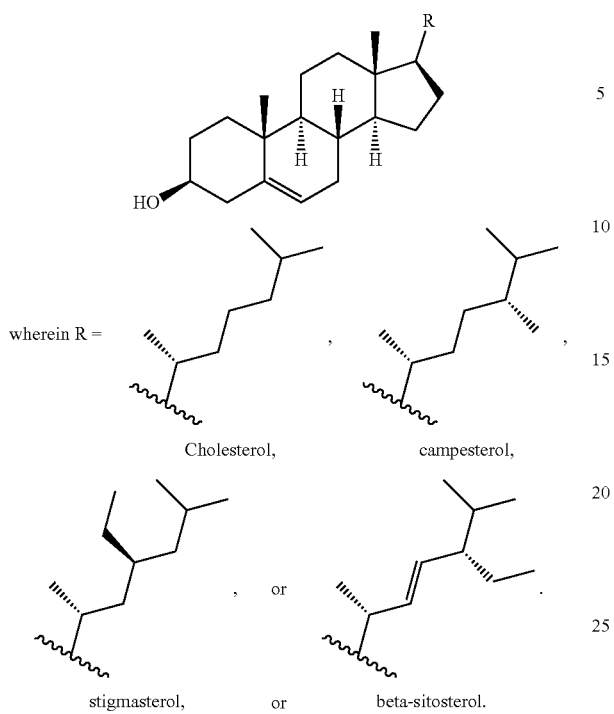

wherein R =

Cholesterol, campesterol, stigmasterol, or beta-sitosterol.

Sterol composition of cholesterol, campesterol, stigmasterol and beta-sitosterol in crude oils is provided in Table 15 below.

TABLE 15

Sterol composition in crude oils (as percentage of total sterol fraction)

| | Cholesterol | Campesterol | Stigmasterol | β-Sitosterol |
|---|---|---|---|---|
| Coconut oil | 0.6-2 | 7-10 | 12-18 | 50-70 |
| Corn oil | 0.2-0.6 | 18-24 | 4-8 | 55-67 |
| Cottonseed oil | 0.7-2.3 | 7.2-8.4 | 1.2-1.8 | 80-90 |
| Olive oil | 0-0.5 | 2.3-3.6 | 0.6-2 | 75.6-90 |
| Palm oil | 2.2-6.7 | 18.7-29.1 | 8.9-13.9 | 50.2-62.1 |
| Palm kernel oil | 1-3.7 | 8.4-12.7 | 12.3-16.1 | 62.6-70.4 |
| Peanut oil | 0.6-3.8 | 12-20 | 5-13 | 48-65 |
| Rapeseed oil | 0.4-2 | 18-39 | 0-0.7 | 45-58 |
| Soybean oil | 0.6-1.4 | 16-24 | 16-19 | 52-58 |
| Sunflower oil | 0.2-1.3 | 7-13 | 8-11 | 56-63 |

Applicants are further investigating metabolism of the following compounds by the presently disclosed cholesterol oxidoreductases. These compounds, if metabolized, would be important for human health, and could inactivate the corticosteroid prednisone used to treat IBD.

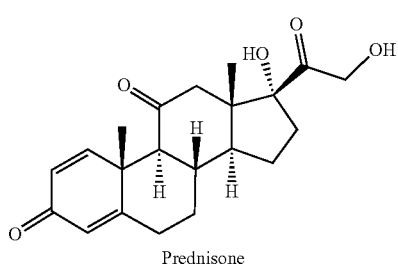

Prednisone

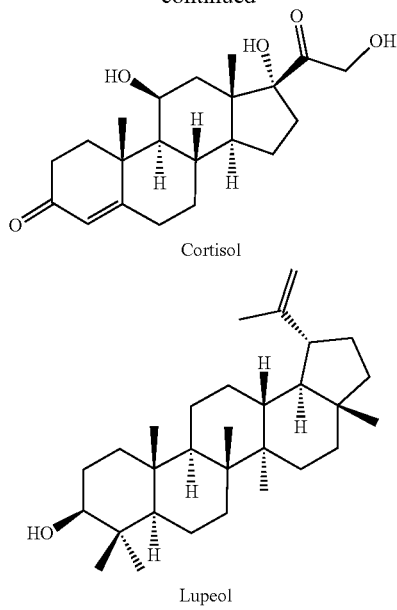

Cortisol

Lupeol

Example 3—Identification of Putative Cholesterol Metabolizing Enzymes Human Gut Microbe Assemblies This Example at least examines the putative gut organisms and enzymes responsible for converting cholesterol to coprostanol in the human gut microbiota. To do so, a three-tiered, multi-disciplinary analysis was used that employed 1) integration of large-scale human stool microbiome and metabolomics datasets, 2) mining the genomes of previously proposed coprostanol producing microbes and 3) employing biochemical knowledge to prioritize enzymes with catalytic capabilities needed to metabolize cholesterol (FIGS. 17A-17D).

Figure 22A:
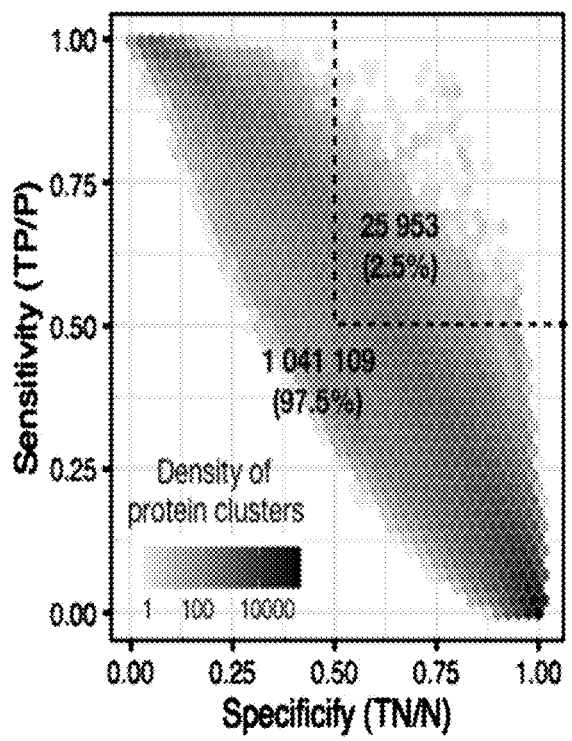
FIG. 22A-22D Replication of bioinformatic analysis of assembled human gut microbiome gene catalogue in an independent dataset with paired stool metagenomes and metabolomes.
Figure 22B:
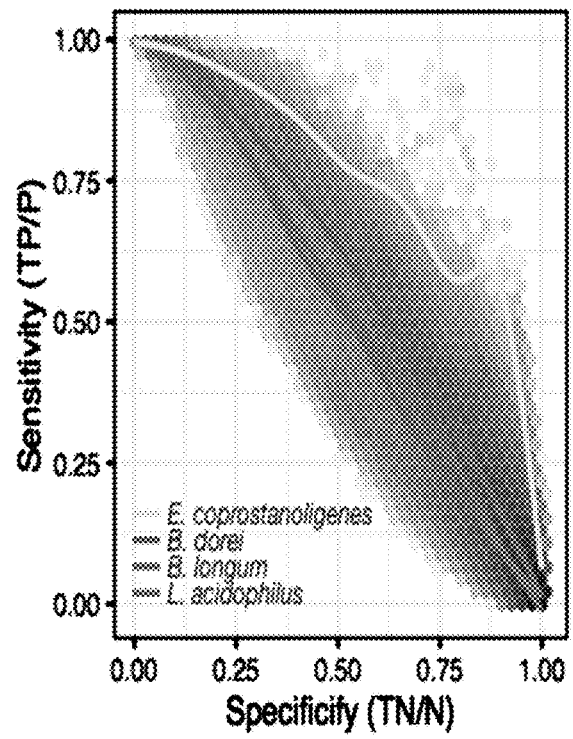

The process began by analyzing gut microbiomes for enzyme-encoding genes associated with the presence of coprostanol in stool metabolomes. To avoid constraints imposed by reference genomes, which do not represent the full spectrum of microbiome enzymatic diversity, de novo assembly of gut microbiome datasets from geographically diverse locations (N=3,097) was performed resulting in 5,929,528 non-redundant complete genes. These were further grouped into clusters of homologous proteins (sequence-based homology, min. 50% AA identity) in order to connect proteins with similar molecular functions and facilitate integrative analysis with stool metabolomics readouts (Suzek et al., 2015). A total of 625 samples from two independent datasets had paired fecal metagenomics and metabolomics measurements, which can be used to identify associations between metabolites and genes found within a microbiome (Franzosa et al., 2019); (Lloyd-Price et al., 2019). To find proteins associated with coprostanol production in vivo, the presence of homologous protein clusters was correlated to the presence of coprostanol across these samples (FIG. 17A, FIG. 22A) and derived metrics of specificity and sensitivity that represent how well the presence or absence of a protein cluster corresponds to the detection of coprostanol. In dataset 1, 91% of tested protein clusters (~909 k) had specificity or sensitivity <0.5, showing poor correlation with coprostanol; similarly, no obvious candidate cluster with both specificity and sensitivity close to 1 was revealed (FIG. 17A). Overall, a similar distribution of coprostanol to protein clusters was observed in dataset 2 (FIG. 22A). One potential explanation for this observation is that different species with more divergent enzymes (<50% AA identity) are responsible for coprostanol formation in human microbiomes, which would result in multiple clusters with lower sensitivity (but high specificity) contributing to the total number of coprostanol positive samples across the cohort. Under this assumption, if the protein clusters were defined with >0.3 sensitivity and >0.9 specificity for coprostanol as the most promising candidates for experimental validation, this stringent cut-off would still yield thousands of candidates (dataset 1=33 k, dataset 2=2 k), necessitating additional prioritization steps.

Figure 24:
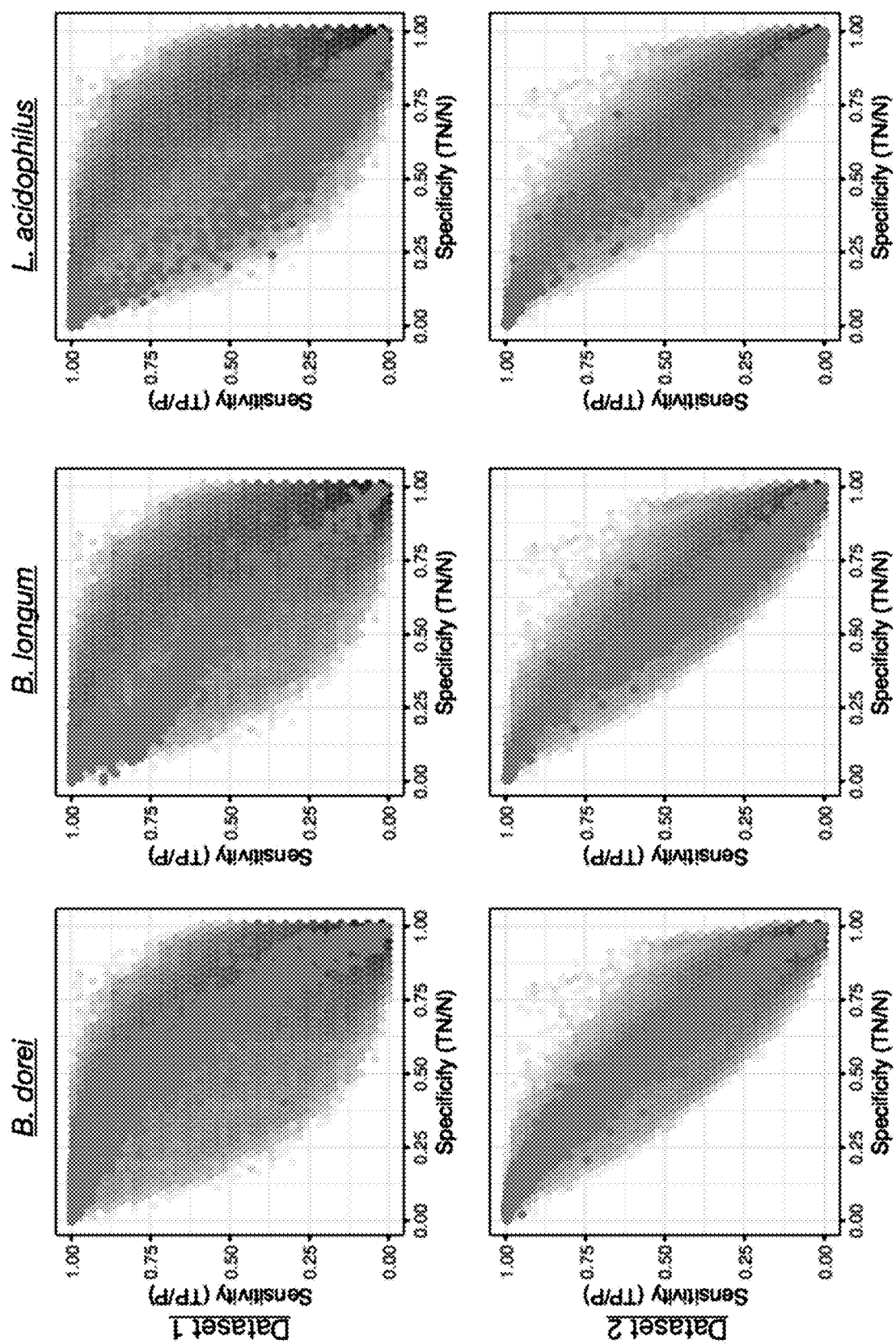
FIG. 24 Clusters of proteins with homology to proteins encoded by gut microbes previously implicated in coprostanol formation.

To identify protein clusters most likely to contain cholesterol metabolizing enzymes, genomic information from previously reported coprostanol forming microorganisms *Eubacterium coprostanoligenes, Bacteroides dorei, Lactobacillus* sp. and *Bifidobacterium* sp (Freier et al., 1994; Gerard et al., 2007; Lye et al., 2010) was integrated. First, coprostanol formation by *E. coprostanoligenes* HL (ATCC 51222) was validated, a hog sewage lagoon isolate which is the only publicly available strain displaying characteristics of the coprostanol-forming *Eubacterium* strains isolated in the 20th century (FIG. 23A) (Freier et al., 1994). Although additional studies have suggested that *B. dorei, Lactobacillus* and *Bifidobacterium* species can also perform this transformation, coprostanol formation in a targeted screen of 17 different isolates of these species was not observed (Table 3); this activity is potentially a strain-specific adaptation and not a core function in these species (Freier et al., 1994; Gerard et al., 2007; Lye et al., 2010); (Norin et al., 1991; Vatanen et al., 2019). As *E. coprostanoligenes* HL is the only available isolated bacterial isolate capable of cholesterol metabolism, a high-quality genome was sequenced and assembled to search for enzymes involved in coprostanol formation (Parmentier and Eyssen, 1974). Excitingly, ~80% of *E. coprostanoligenes* proteins could be mapped to the de novo assembled clusters of homologous proteins (50% AA similarity), and 328 of these proteins showed >0.3 sensitivity and >0.9 specificity for coprostanol detection (FIG. 17B). In comparison, there were only 12 such proteins identified from all other reported coprostanol forming species, making these species unlikely candidates for coprostanol formation in human microbiomes (FIG. 24). Altogether, by integrating screening results and genomic information, candidate enzymes involved in cholesterol metabolism were greatly narrowed down.

Figure 16:
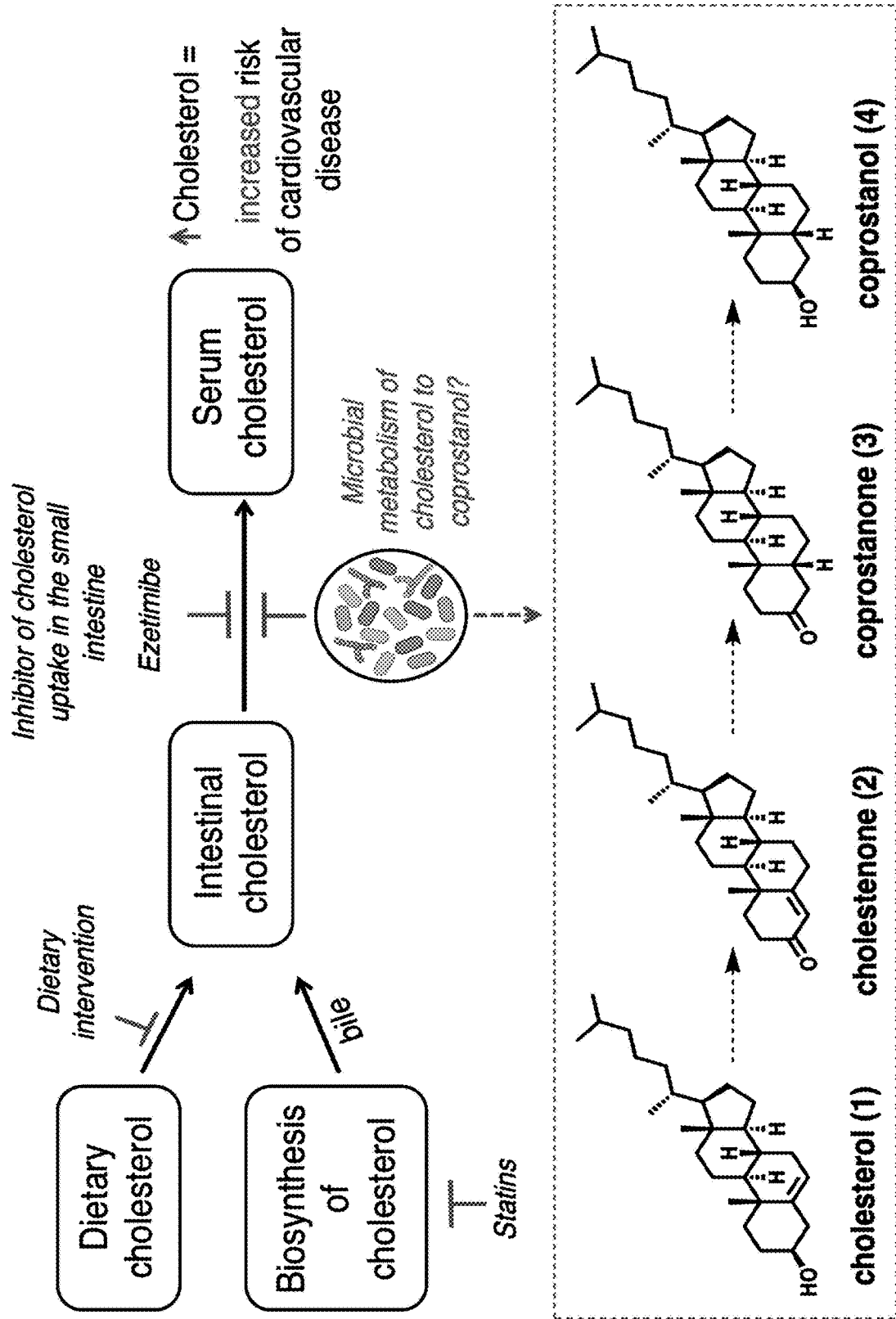
FIG. 16 Levels of serum cholesterol are important for human health and can be modulated by a variety of factors, including the potential metabolism of cholesterol by the gut microbiota. Intestinal cholesterol levels are influenced by both dietary and host-derived cholesterol. Intervention by changes in diet or use of statins both affect levels of intestinal cholesterol, while the use of ezetimibe blocks uptake of intestinal cholesterol. Gut microbial metabolism of cholesterol may also serve to reduce cholesterol absorption in the intestine, resulting in lower serum cholesterol levels. The proposed pathway for microbial conversion of cholesterol (1) to coprostanol (4) in *Eubacterium coprostanoligenes*, a hog sewage isolate, involves the intermediates cholestenone (2) and coprostanone (3).
Figure 23C:
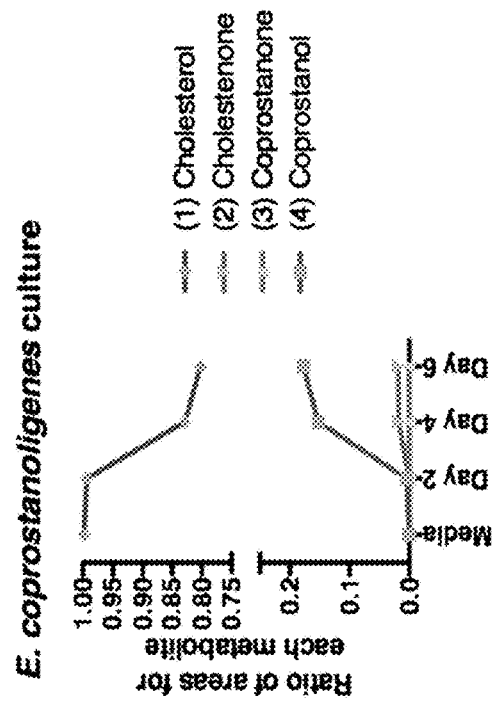

Without being bound by theory, it was hypothesized that the human gut microbial enzymes responsible for coprostanol formation would be related to the as-yet-undiscovered cholesterol-metabolizing enzyme(s) from *E. coprostanoligenes* and it was next investigated how coprostanol formation is accomplished by this organism. Earlier studies using labeled cholesterol determined that coprostanol formation in this organism proceeds through an indirect reduction pathway involving the initial oxidation of cholesterol (1) to cholestenone (2) (FIG. 16) (Björkhem and Gustafsson, 1971; Ren et al., 1996). To verify this finding, the activity of *E. coprostanoligenes* lysates towards cholesterol under both aerobic and anaerobic conditions was tested. Conversion of cholesterol to cholestenone was observed and it was discovered that this reaction requires NADP$^+$ and is oxygen-independent (FIGS. 23B, 23C). The putative second step of this pathway, the formation of coprostanone (3) from cholestenone (2), did not occur in lysates, suggesting that either the assay conditions need further optimization or the putative enzyme becomes inactivated during cell lysis. Therefore, finding the cholesterol-oxidizing enzyme was prioritized.

Figure 22C:
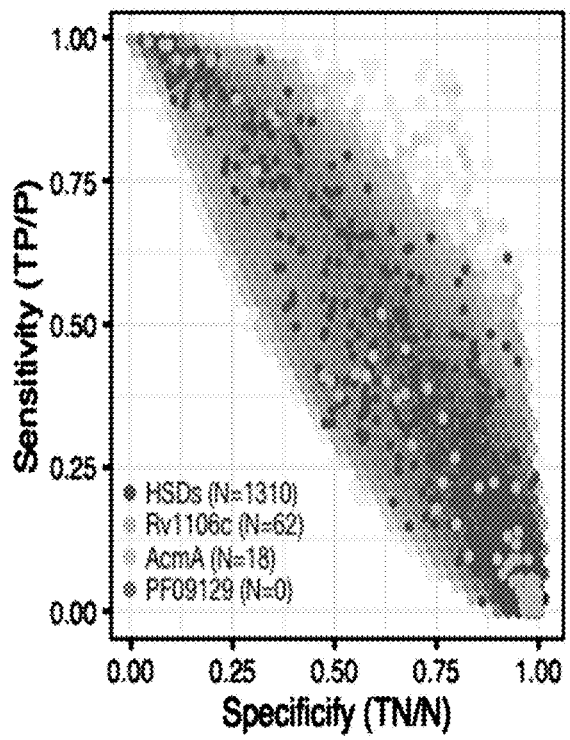

Given that cholesterol oxidation in *E. coprostanoligenes* cell lysate was oxygen-independent and the gut is an anaerobic environment, it was reasoned that the well-studied oxygen-dependent cholesterol oxidases (PF09129) found in many *Streptomyces* species were unlikely to mediate this transformation (Kreit and Sampson, 2009). Accordingly, no homologs of any queried cholesterol oxidases were found in the genome of *E. coprostanoligenes* or our entire human microbiome gene catalogue. The only characterized oxygen-independent enzymes capable of this reaction are AcmA (PF01370) from the soil bacterium *Sterolibacterium denitrificans* and the cholesterol oxidoreductase Rv1106c from *Mycobacterium tuberculosis* (Chiang et al., 2008; Yang et al., 2007). While no homologs of AcmA or Rv1106c were found in the genome of *E. coprostanoligenes*, there were a significant number of homologs in the human microbiome gene catalogue; however, none of the homologs had high specificity and sensitivity for coprostanol in our two metabolomics datasets (FIG. 17C, FIG. 22C, Table 4).

Figure 22D:
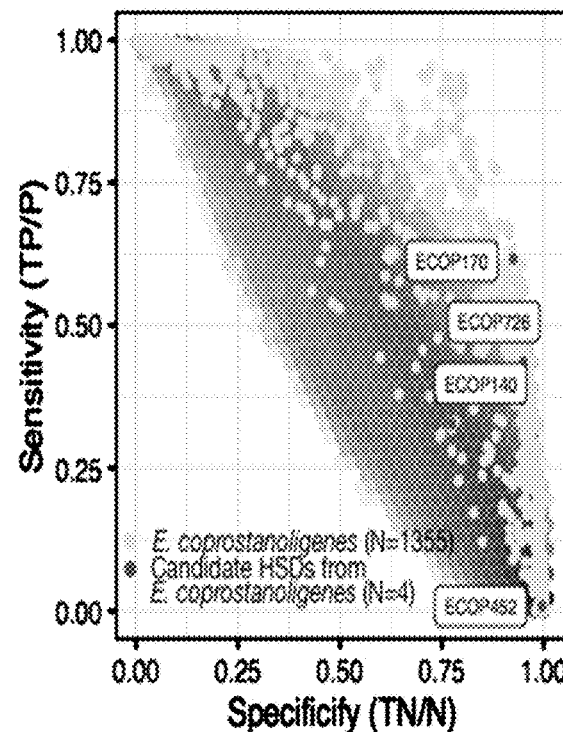

The final class of enzymes considered was the hydroxysteroid dehydrogenases (HSDs), which belong to the short-chain dehydrogenase (SDR) enzyme family (PF00106). These enzymes are found in many gut microbes and can oxidize hydroxyl groups of bile acids to ketones in NAD(P)$^+$ dependent, oxygen-independent manner (Devlin and Fischbach, 2015). However, no characterized gut microbial HSDs are known to accept cholesterol as a substrate. Using 6 biochemically characterized bile acid-metabolizing HSDs from gut microbes (*E. lenta, R. gnavus, E. coli*) as a query, 1,310 clusters of homologous proteins in the human microbiome gene catalog were found. Four of the HSD clusters contained homologs of *E. coprostanoligenes* proteins, including a cluster of 25 proteins that was associated with coprostanol formation in stool with 0.92 specificity and 0.68 sensitivity (FIG. 17D, FIG. 22D, Table 5). In summary, this metagenome-wide search combined with metabolomics-, genome- and enzyme-guided bioinformatics distilled 6M microbiome genes into 4 protein clusters that were prioritized for experimental validation.

Figure 18B:
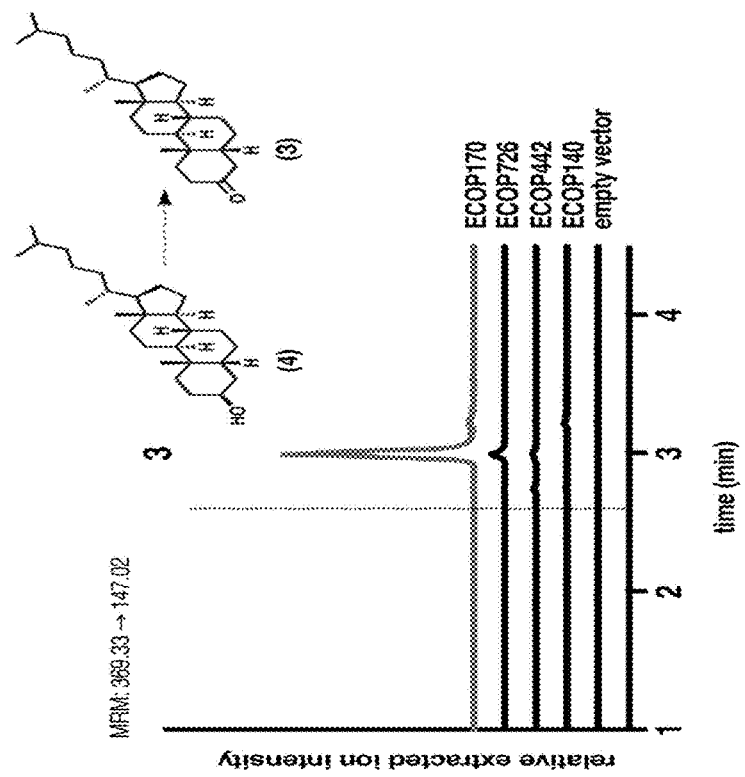
Figure 18A:
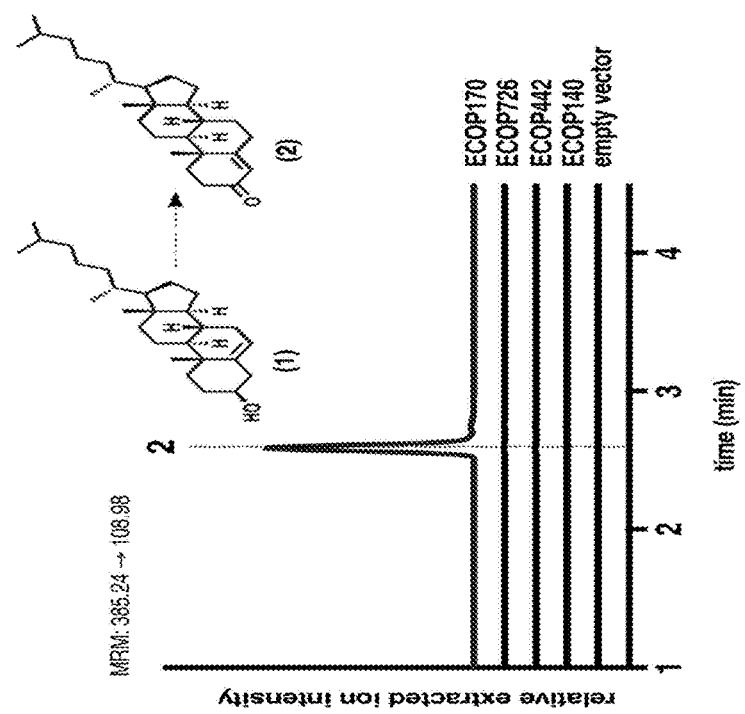
Figure 18C:
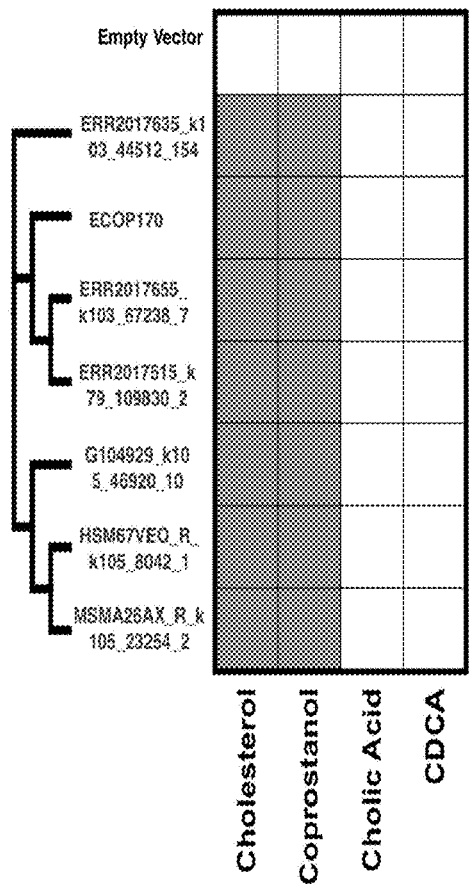
Figure 18C:
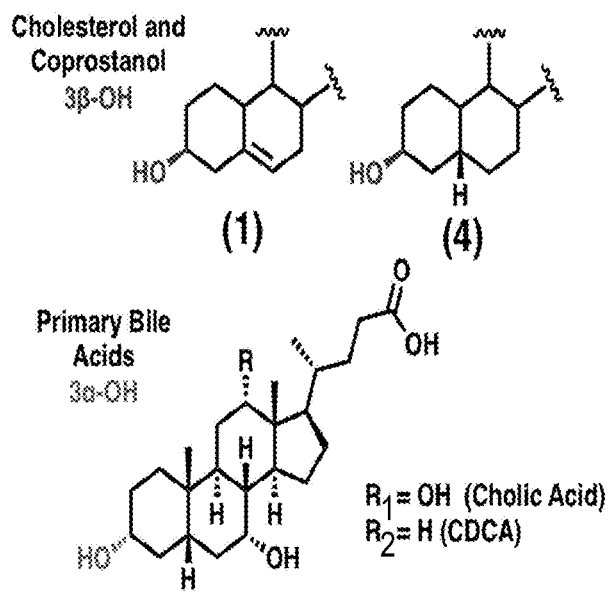

Example 4—Biochemical Characterization of Putative Gut Microbial Cholesterol Oxidoreductases To test whether proteins from these prioritized clusters could oxidize cholesterol (1) to cholestenone (2), each of the four putative HSDs encoded by *E. coprostanoligenes* was expressed in *E. coli* and evaluated the reactivity of cell lysates toward cholesterol (FIG. 18A). ECOP170 (WP_078769004.1), the *E. coprostanoligenes* HSD (ECOP170) with the highest specificity towards coprostanol in stool metabolomes, oxidized cholesterol to cholestenone, completing the first step in cholesterol metabolism. ECOP170 also catalyzed the oxidation of coprostanol (4) to coprostanone (3), suggesting it may be responsible for both the first (oxidation of cholesterol to cholestenone) and last (reduction of coprostanone to coprostanol) steps of this pathway (FIG. 18B).

As it is currently impossible to access a targeted knockout of ECOP170 in *E. coprostanoligenes* due to lack of tools for genetic manipulation of this organism, ECOP170's role in cholesterol metabolism was confirmed by measuring its expression levels in active *E. coprostanoligenes* cultures and by matching its cofactor preferences to the activity in *E.*

Figure 25A:
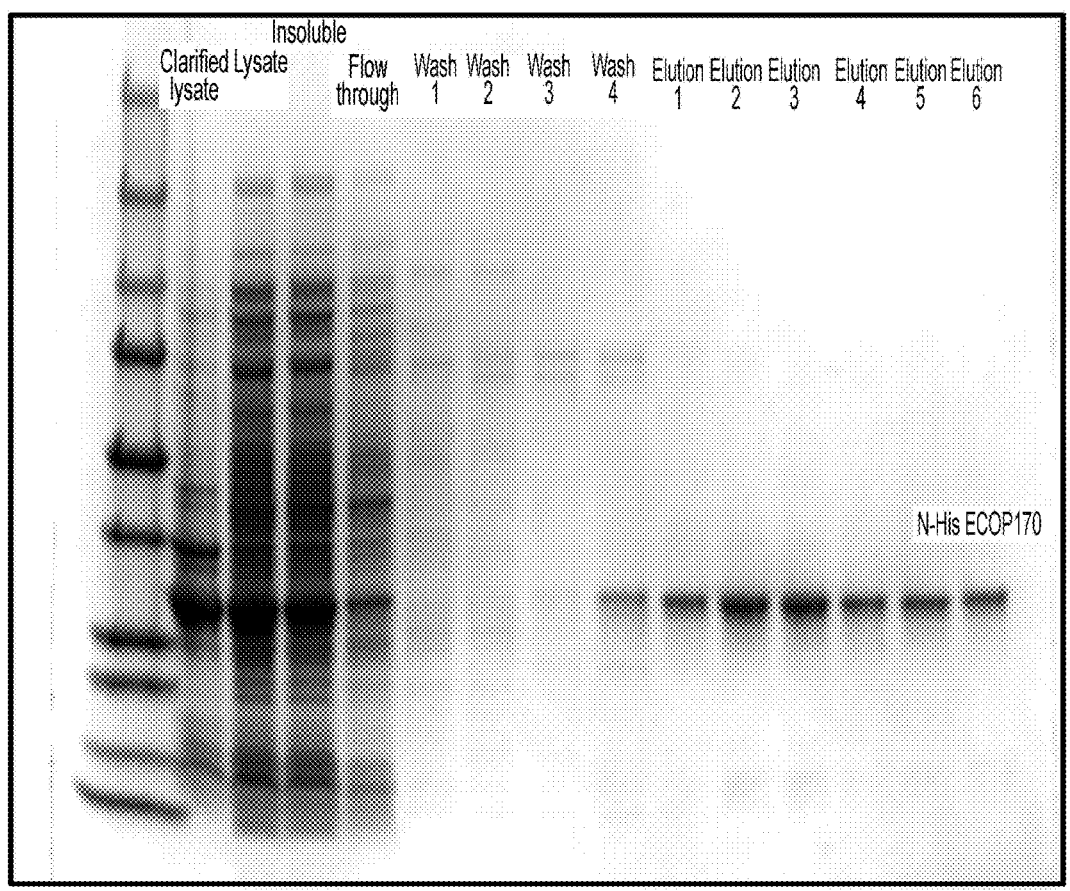
FIG. 25A-25B In vitro activity of purified N-terminal His-tagged ECOP170 expressed in *E. coli* BL21(DE3).
Figure 25B:
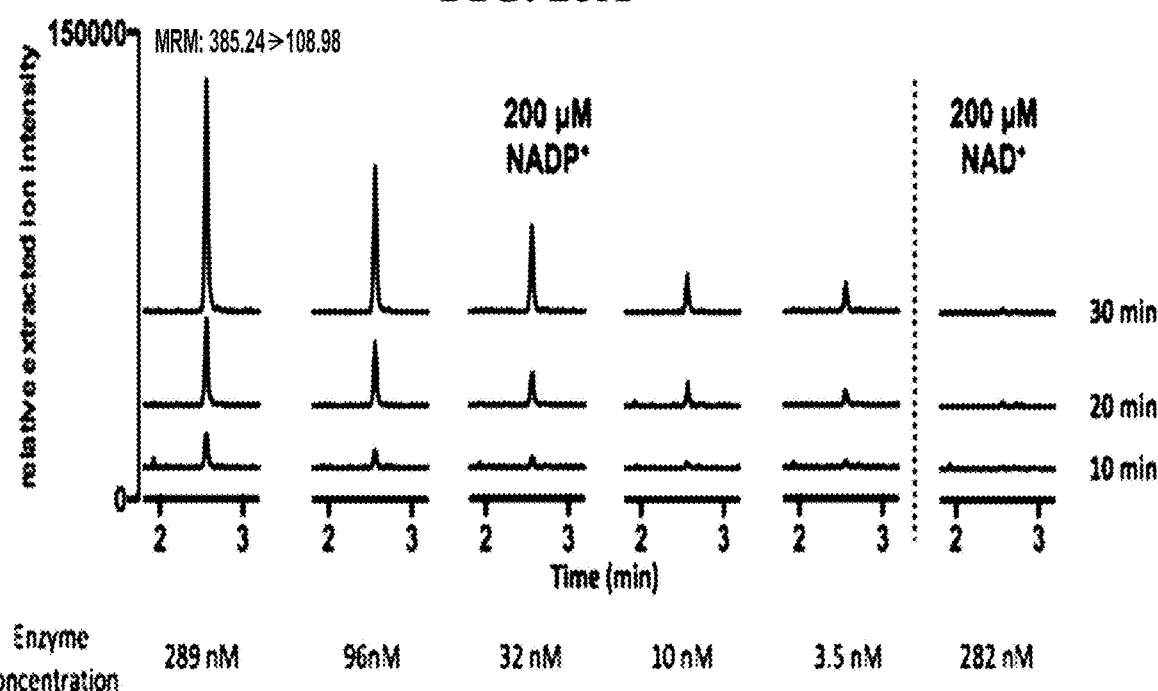

*coprostanoligenes* lysates. To confirm that ECOP170 was expressed by *E. coprostanoligenes* under cholesterol-metabolizing conditions, levels of transcripts encoding all four HSDs were measured when *E. coprostanoligenes* was cultivated with and without cholesterol (FIG. 23D, Table 6). Of these four genes, ECOP170 had the largest increase in expression in medium containing cholesterol compared to medium lacking cholesterol after 2 days of growth (28.9-fold increase), suggesting it is highly induced under conditions where cholesterol is present. In order to determine if ECOP170's cofactor preference matched the activity observed in *E. coprostanoligenes* lysate, N-terminal $His_6$-tagged ECOP170 was purified and assayed it for activity (FIG. 24). Excitingly, ECOP170 showed a strict dependence on $NADP^+$ and not $NAD^+$, directly matching the activity observed in *E. coprostanoligenes* lysate (FIG. 23C, FIGS. 25A-25B). Together these data suggest that ECOP170 is the enzyme responsible for the metabolism of cholesterol to cholestenone in *E. coprostanoligenes*.

Figures 26A, 26B:
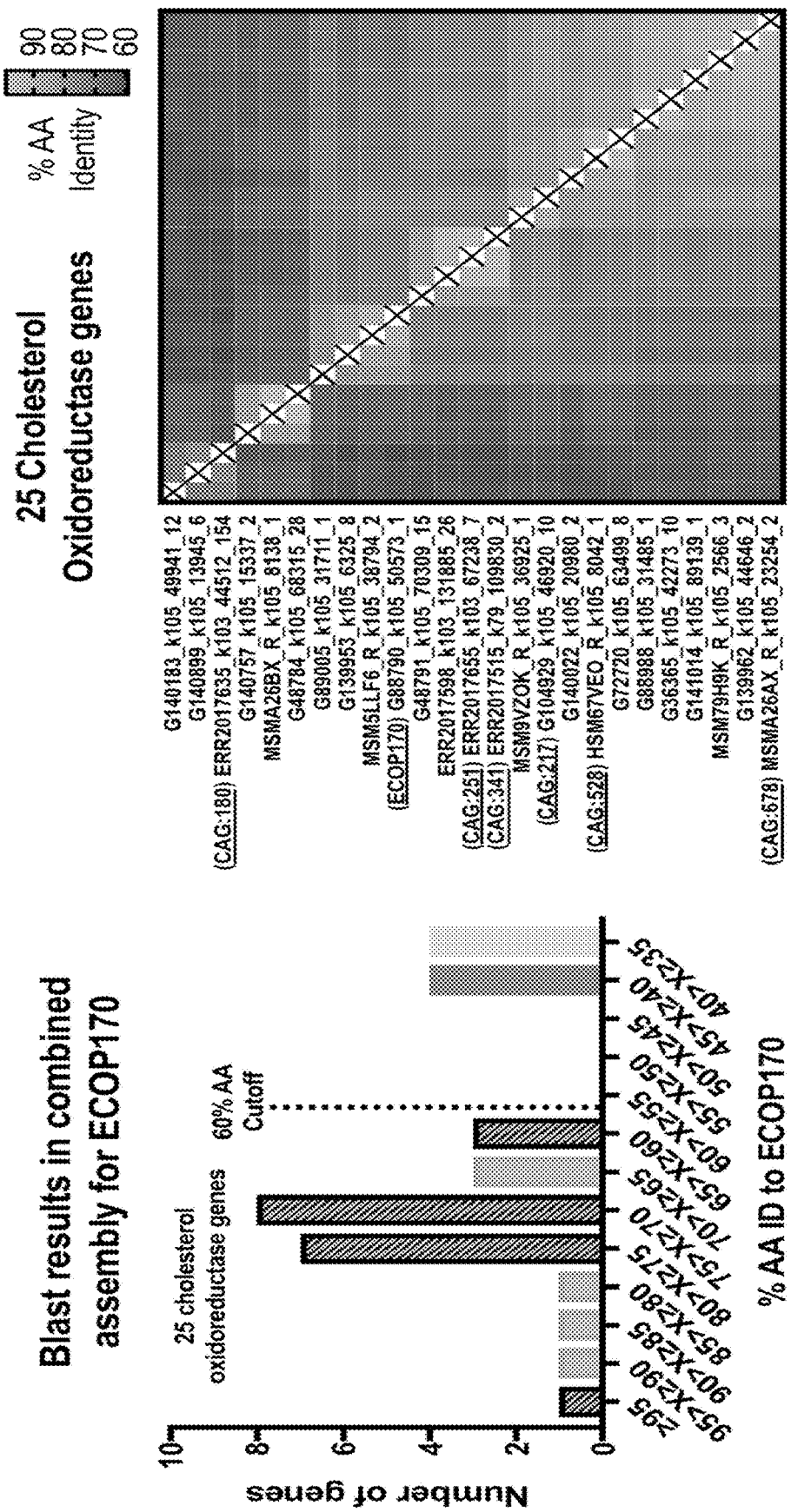
FIG. 26A-26C Identification of human-associated cholesterol oxidoreductases with homology to ECOP170 in the combined assembly of six human cohorts.
Figure 26C:
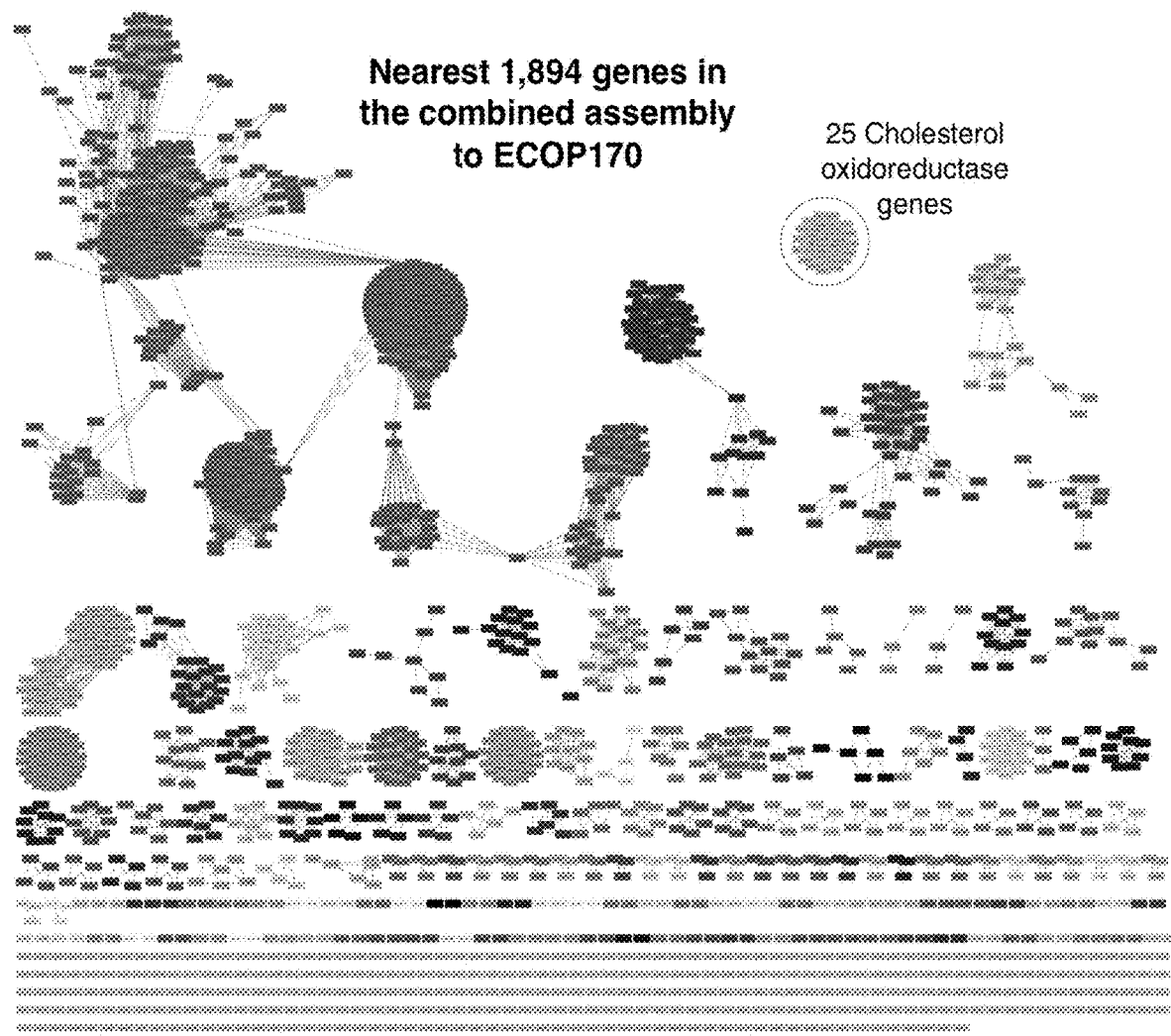
Figure 27A:
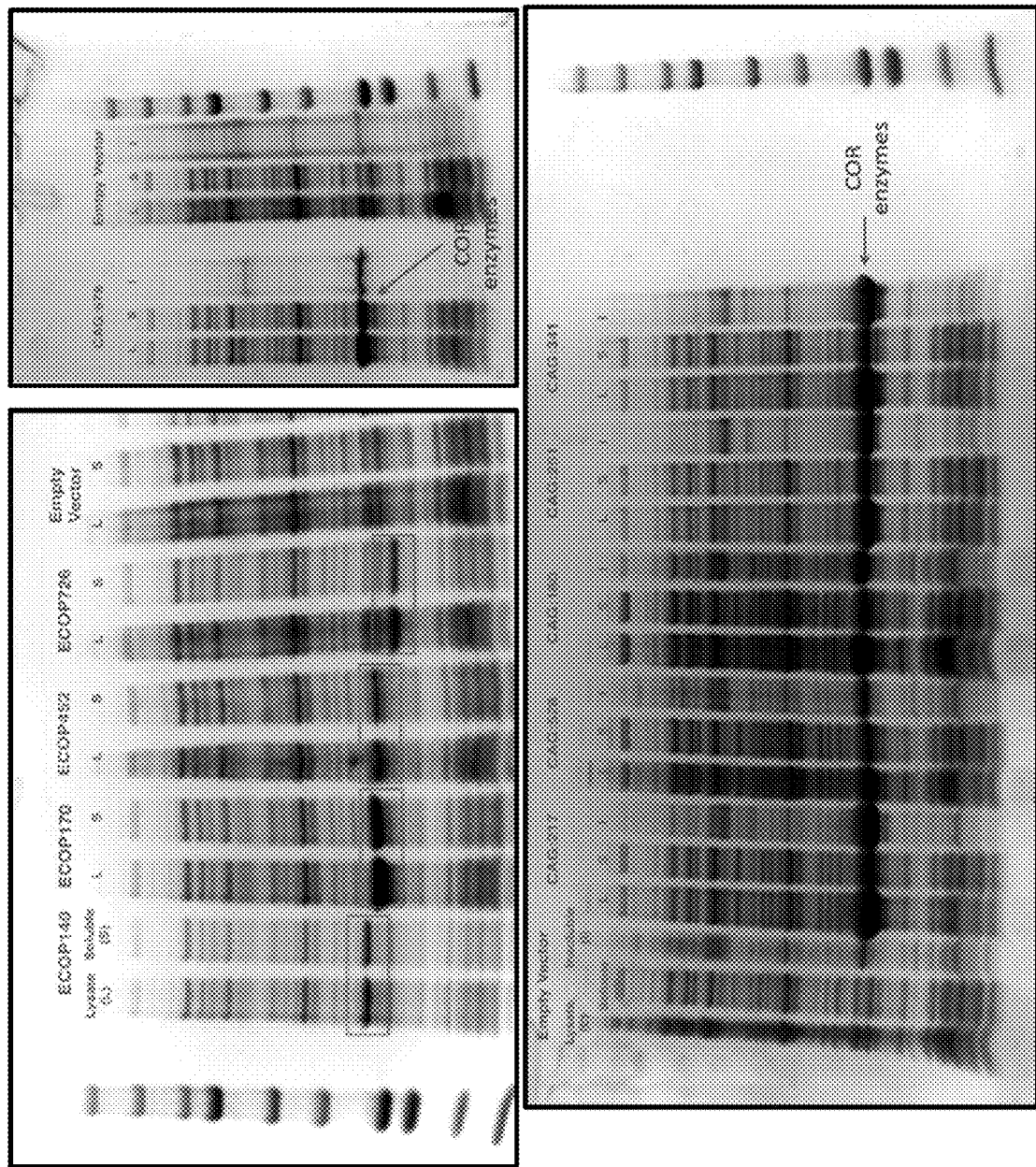
Figure 28A:
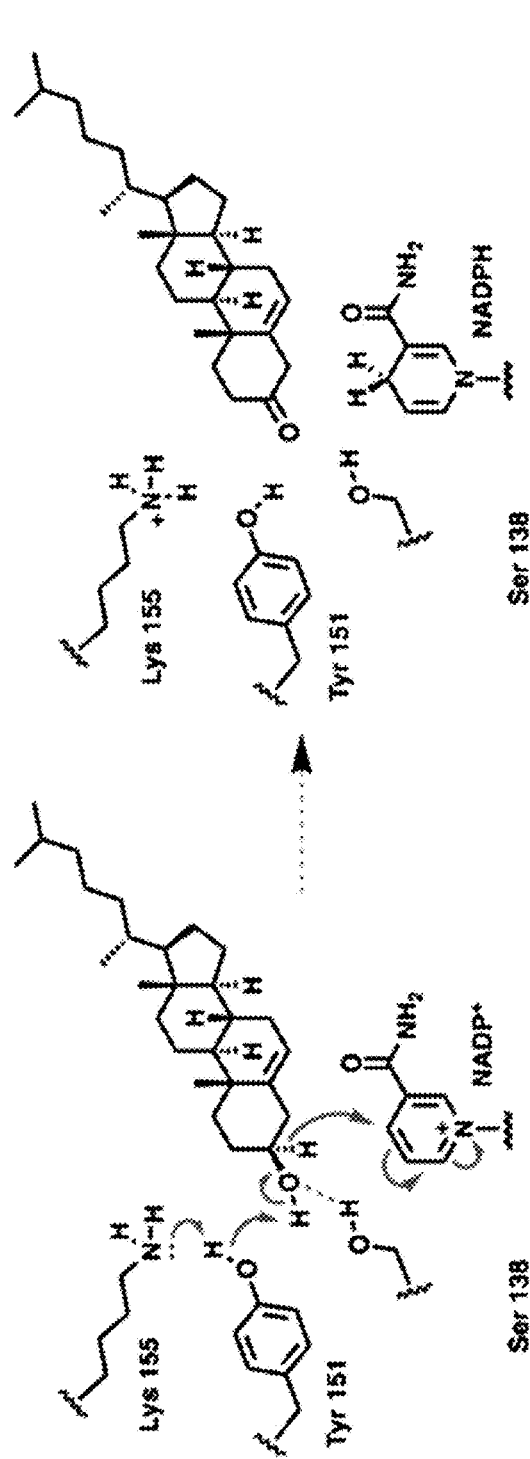
FIG. 28A-28E Mechanism and catalytic residues for hydroxysteroid dehydrogenases.
Figure 28C:
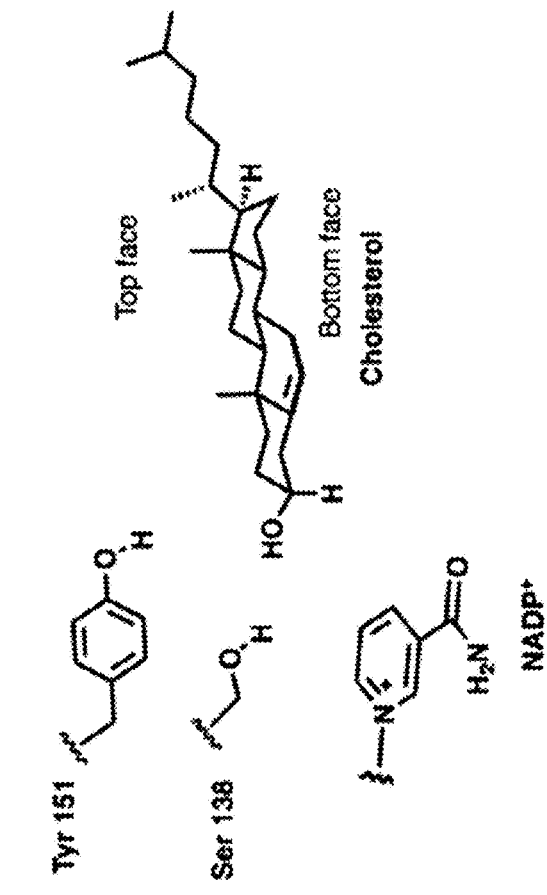
Figure 28B:
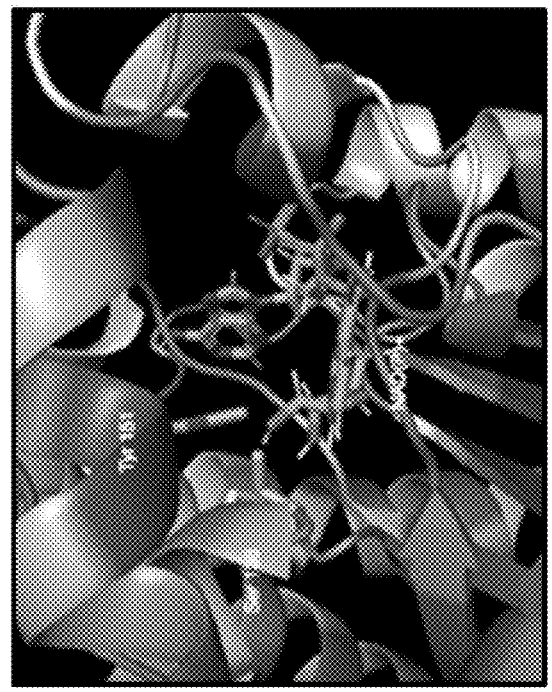
Figure 28D:
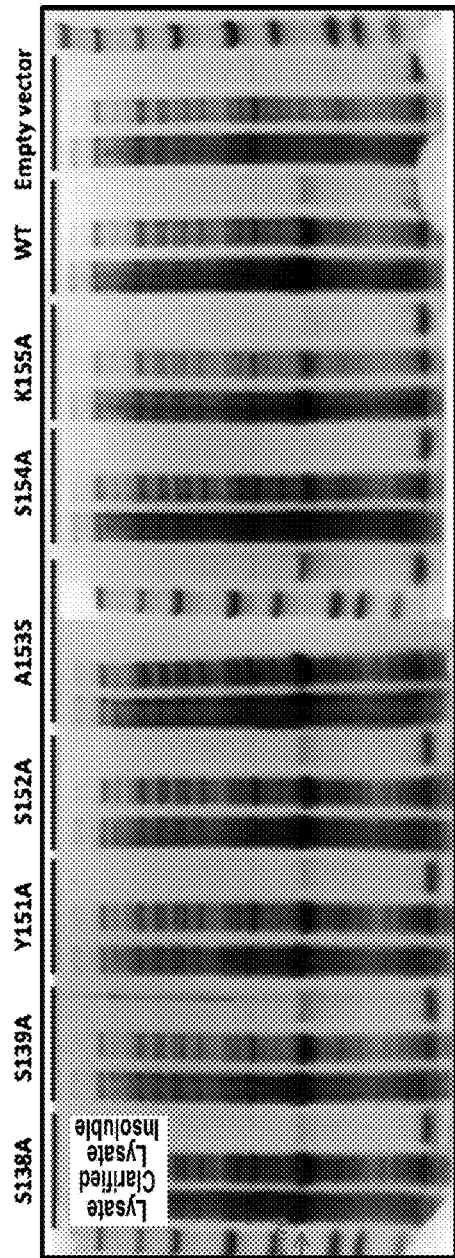
Figure 28E:
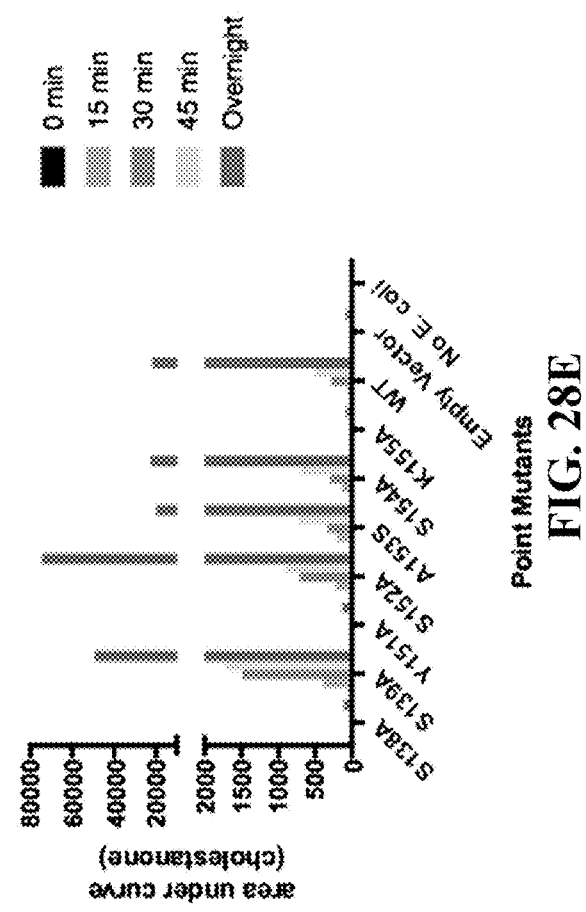

Having determined that ECOP170 is a cholesterol oxidoreductase (COR), the human microbiome gene catalogue was referenced to determine if the other proteins in the ECOP170-containing cluster (all with at least 60% AA identity to ECOP170) could also oxidize cholesterol (Table 7). Of these 25 protein sequences in that cluster, only 10 have been previously deposited in the NCBI database (FIGS. 26A-26C). Interestingly, these 10 homologous enzymes were assigned to co-abundant gene groups (CAGs), i.e. microbial species that lack cultured representatives and have only been identified in gut microbiome assemblies (Nielsen et al., 2014). Furthermore, neither these proteins nor the other 15 proteins within the cluster could be assigned to isolates in the NCBI database or in recently described gut microbiome strain collections (Forster et al., 2019; Zou et al., 2019).

Since there are currently no available human gut microbial isolates encoding any of the ECOP170 homologs, six homologs were selected that were prevalent in the studied datasets and showed a wide sequence diversity for heterologous expression in *E. coli* and in vitro biochemical characterization. All six ECOP170 homologs examined oxidized cholesterol to cholestenone in *E. coli* lysates (FIG. 18C, FIGS. 27A-27D). Furthermore, both ECOP170 and the six homologs showed activity towards coprostanol, but did not oxidize the primary bile acids cholic acid and chenodeoxycholic acid, which have 3α-OH groups rather than 3β-OH groups (FIG. 18C, FIGS. 27A-27D). A multiple sequence alignment of the 25 protein sequences within the ECOP170-containing cluster shows the strictly conserved catalytic triad of Ser-Tyr-Lys required for HSD activity. Mutating any of these three amino acids in ECOP170 led to complete loss of cholesterol oxidizing activity in lysate (FIG. 18D, FIGS. 28A-28D). These data suggest that the homologs of ECOP170 enzymes found in uncultivated human gut bacteria are cholesterol oxidoreductases involved in the first and last steps (FIG. 16) of coprostanol metabolism in human gut microbiomes.

Example 5—Gut Microbial Cholesterol Oxidoreductases are Encoded by a Clade of Prevalent but Uncultured Bacteria Related to Group IV *Clostridium*

Because the 25 cor genes found in human microbiomes could not be mapped back to any publicly available isolate genome, and only 10 of those genes were associated with metagenomic species (Nielsen et al., 2014), it was examined if the other cor genes could also be assigned to uncultivated microbial species. To do this, the assembled human gut metagenomes were binned into metagenomic species (MSPs) using MSPminer and searched these species for the 25 cor genes (Plaza Oiate et al., 2018). Using this approach, 19 of the 25 homologs were successfully assigned to individual MSPs. Similarity based taxonomic annotation of these MSPs at the species level using a comprehensive collection of microbial isolates was unsuccessful, confirming that these cholesterol-metabolizing human gut bacteria are indeed novel and previously uncharacterized. To aid in taxonomic annotation, the phylogenetic relationship of all detected MSPs to known microbial isolates was evaluated using a set of single copy marker genes (PhyloPhlAn (Segata et al., 2013)). In the bacterial tree of life, the 18 COR-encoding MSPs and *E. coprostanoligenes* form a coherent clade that phylogenetically neighbors with *Clostridium* cluster IV. Cluster IV contains species such as *Faecalibacterium prausnitzii*, *Clostridium leptum* and *Ruminococcus bromii* (FIG. 19A) that possess metabolic capabilities linked to host health, including short-chain fatty acid production (Lopetuso et al., 2013). In the direct neighborhood of COR-encoding MSPs an additional 9 MSPs were observed; upon further examination of their high-quality draft genome assemblies, two of them (msp_0910 and msp 0832) were also confirmed to encode cor genes. In case of msp_0832, its cor gene was missed in the original assembly of the non-redundant gene catalogue, which suggests that additional examples of cor genes and COR-encoding species might be uncovered by employing different assembly techniques. Furthermore, generation of at least one high quality draft genome for most of the COR-encoding MSPs was successful (completeness >90%, contamination <5% (Parks et al., 2015) (Table 8), and genome-wide similarity comparison revealed that these MSPs indeed are different species with maximum average nucleotide identity of 88% (Table 1) (Jain et al., 2018). Finally, the high quality genomes of COR-encoding MSPs were compared with previously recovered novel MSPs from human gut metagenomes and confirmed that all but two of these species were also catalogued in earlier efforts (FIG. 29B, Table 9) (Almeida et al., 2019; Nielsen et al., 2014; Pasolli et al., 2019; Plaza Ofiate et al., 2018).

Figure 19B:
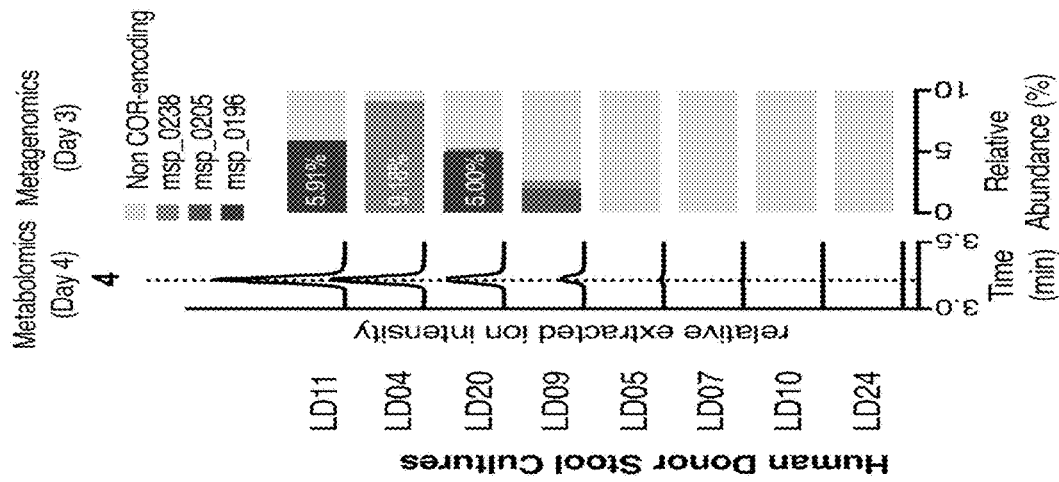
FIG. 19A-19D Cholesterol oxidoreductase encoding gut bacteria are uncultured members of group IV *Clostridium* and are prevalent across geographically diverse human populations.
Figure 19A:
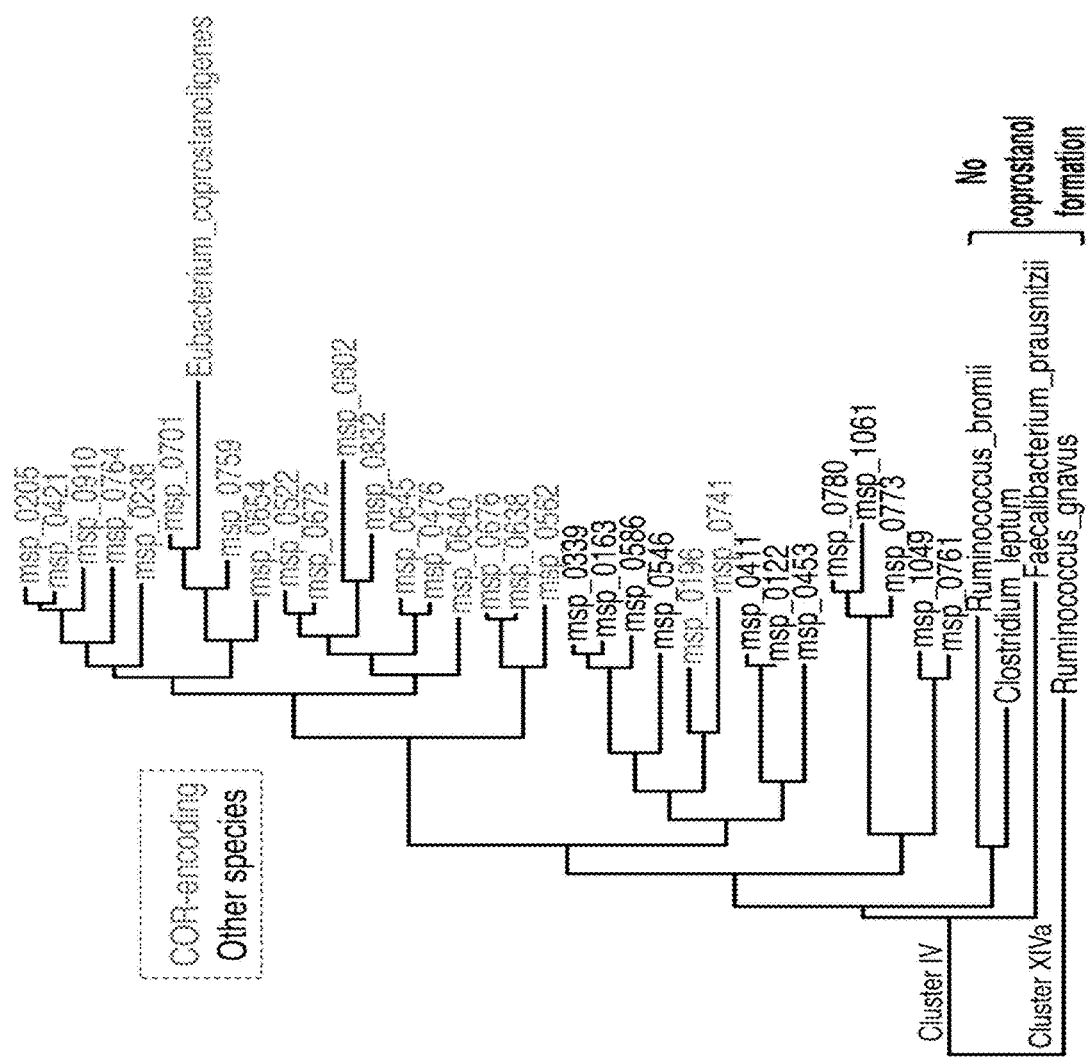
Figure 30:
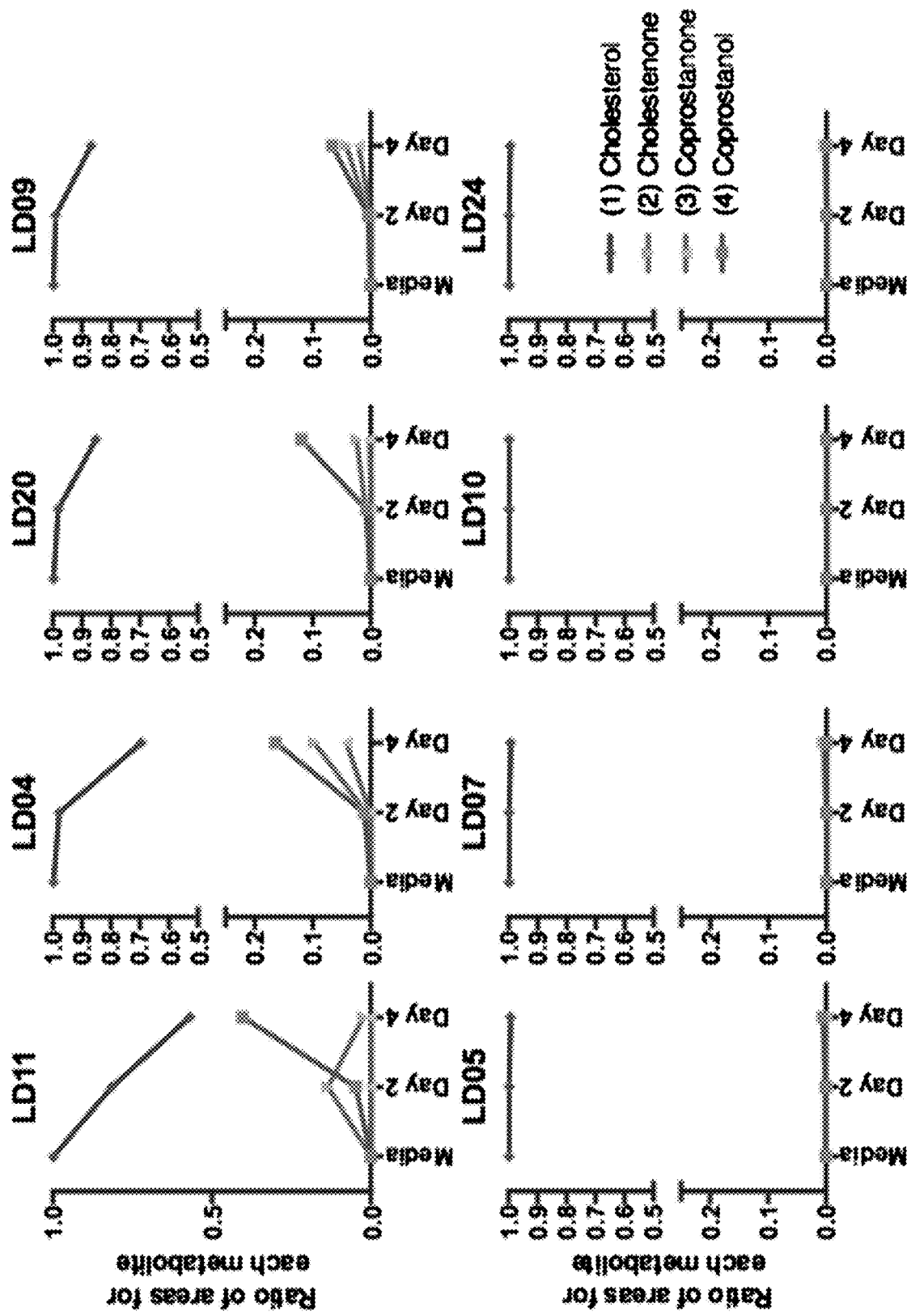
FIG. 30 Measurements of cholesterol, cholestenone, coprostanone, and coprostanol by stool cultures at days 2 and 4.

Given the lack of coprostanol-forming human gut isolates, it was tested whether microbial communities containing COR-encoding species could generate coprostanol ex vivo. To accomplish this, stool samples from eight healthy donors were anaerobically cultured in cholesterol-containing medium for four days, with metagenomic sequencing performed on Day 3 and levels of cholesterol, cholestenone and coprostanol measured on Days 2 and 4. In the four samples where coprostanol was produced on Day 4, COR-encoding bacteria could be detected, while samples without coprostanol lacked COR-encoding bacteria, further connecting the presence of these species in complex microbial communities with cholesterol metabolism (FIG. 19B, FIG. 30). While complete conversion of cholesterol to coprostanol was never observed, similar levels of coprostanol were formed in the stool cultures as in axenic cultures of *E. coprostanoligenes*, suggesting there may be a limit to this metabolic transformation under these specific culture conditions (FIG. 23A).

Figures 19C, 19D:
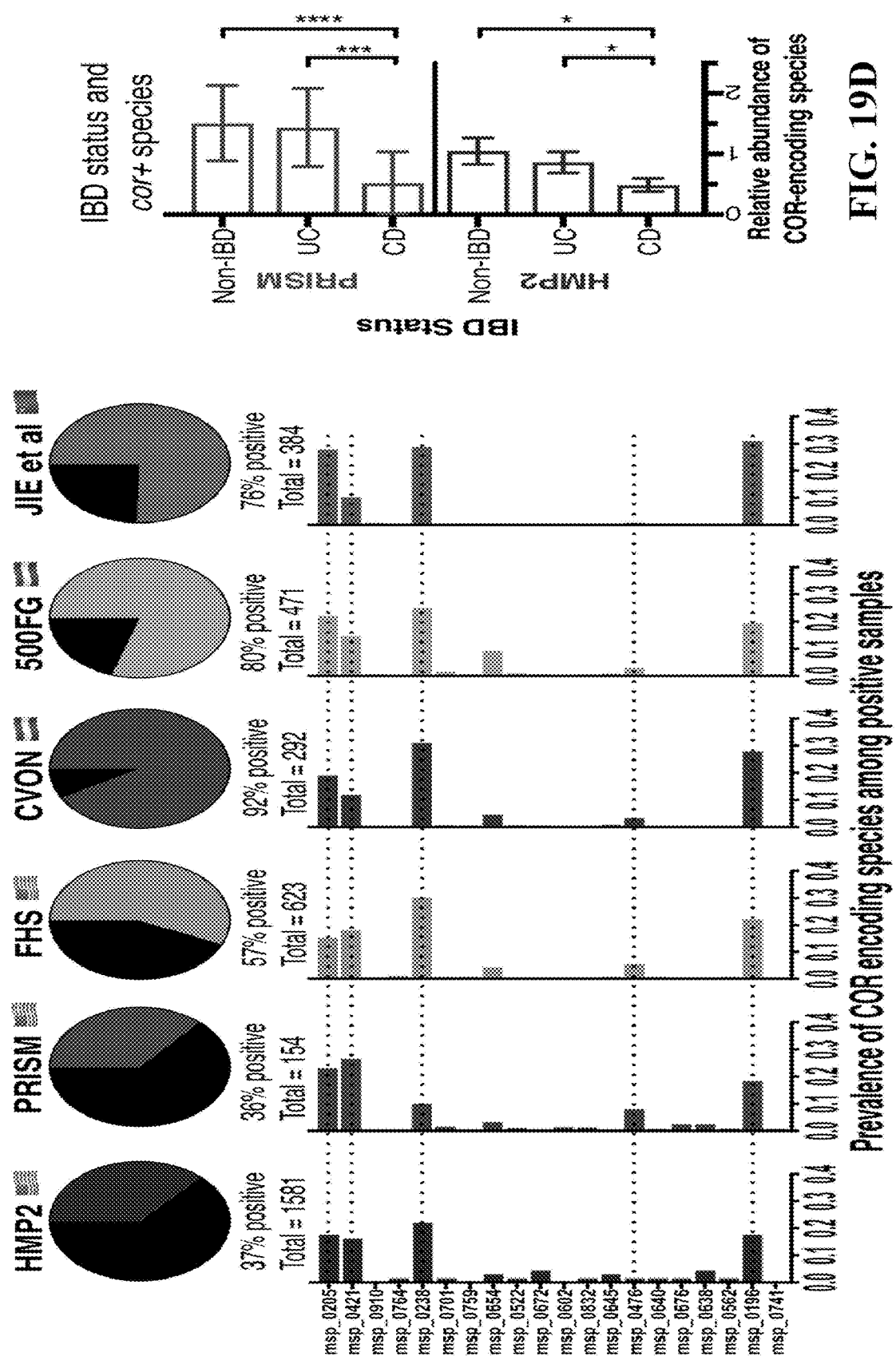

To understand the distribution of the 20 COR-encoding species in the human gut, the metagenomic datasets were stringently mapped against the non-redundant gene catalogue to calculate the prevalence and relative abundance of the individual species in each dataset. Across the six cohorts used to make the initial assembly, COR encoding species had an average relative abundance of 1.4% (FIG. 29B), while the percentage of samples containing a COR-encoding species varied from 37% of samples in the Human Microbiome Project 2 (HMP2) cohort to 92% of samples in the CVON cohort (FIG. 19C). The two cohorts with the lowest percentage of encoders were PRISM and HMP2, both of which contain significant numbers of samples from inflammatory bowel disease (IBD) patients. In these two IBD cohorts it was observed that Crohn's disease was significantly associated with decreased abundance of COR-encoding species, suggesting that these bacteria may be sensitive to terminal ileum inflammation (FIG. 19D) (Santoru et al., 2017; Sundqvist et al., 2019). The COR homologs that were characterized in vitro were encoded by the most prevalent MSPs found in all six cohorts (FIG. 19C); msp_0205, msp_0238 and msp_0196 were also present in the coprostanol producing stool cultures (FIG. 19B). Together, these data support the idea that COR-encoding bacteria are prevalent constituents of the human gut microbiome where they convert cholesterol to coprostanol.

Figure 20A:
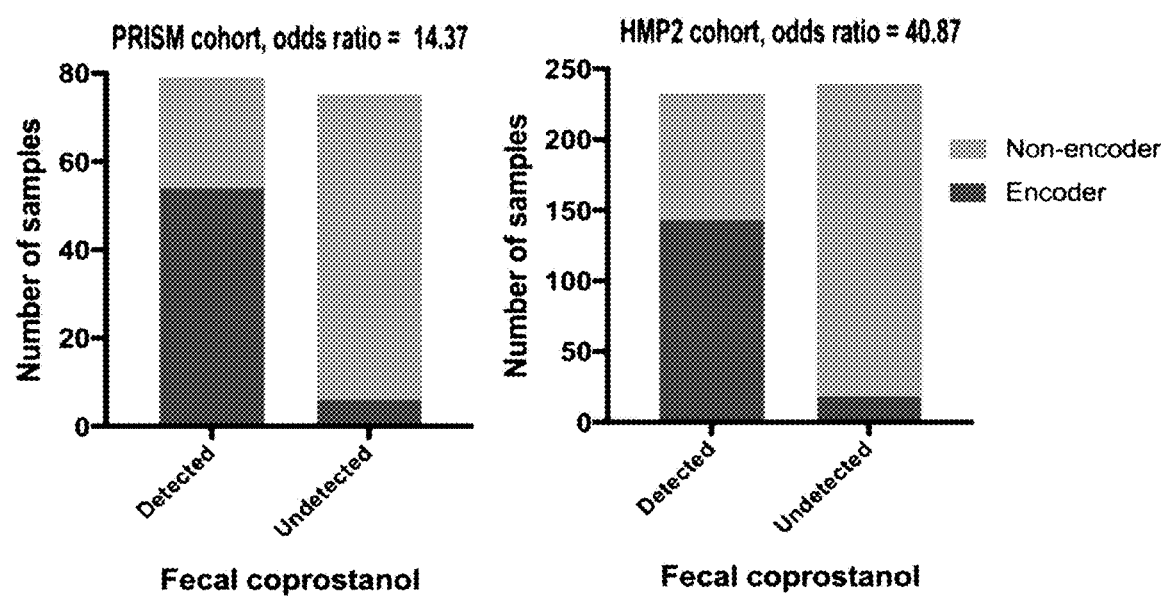
FIG. 20A-20C Fecal coprostanol formation is correlated to the presence of cholesterol oxidoreductase homologs in gut microbiomes.
Figure 20B:
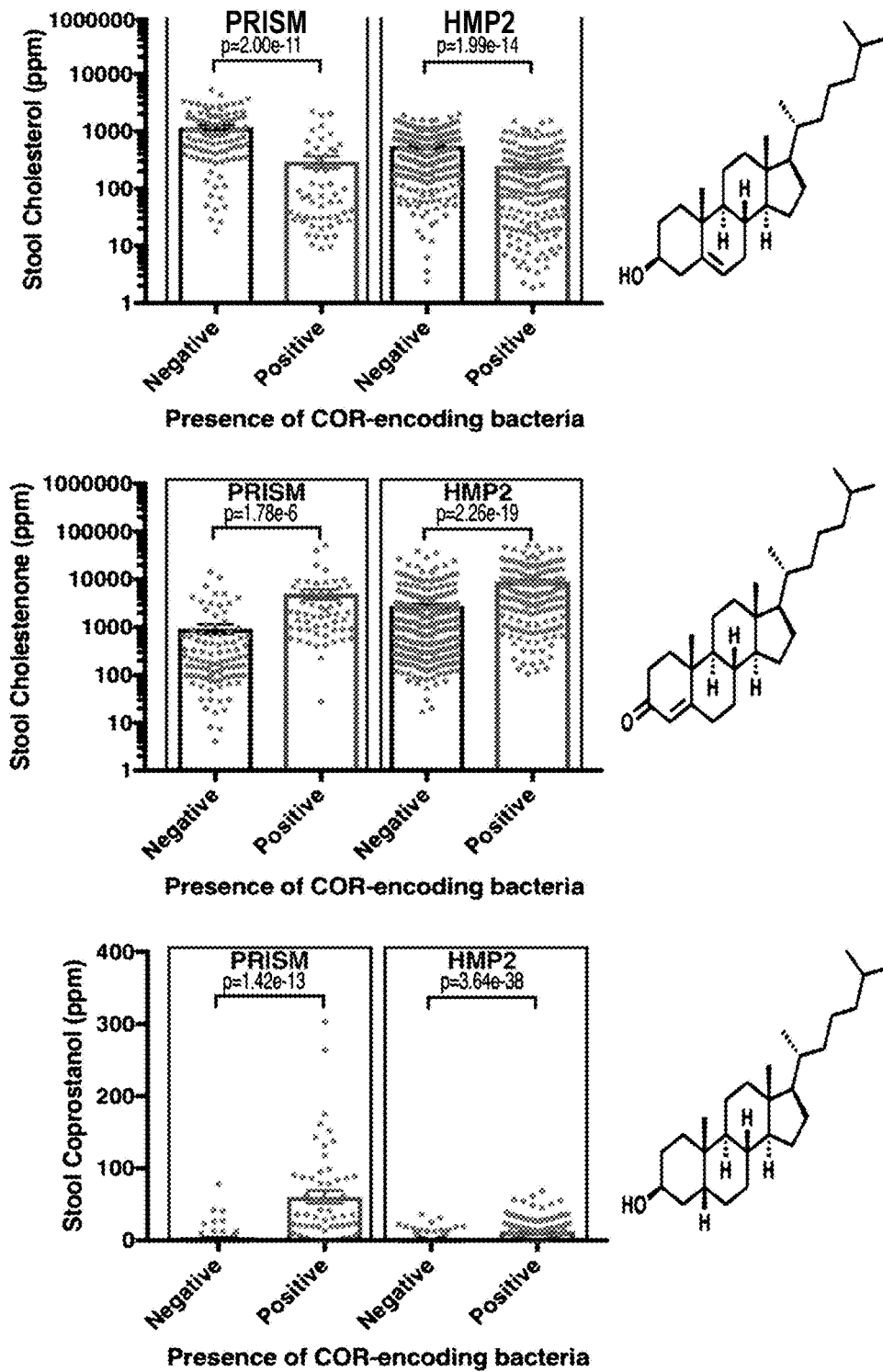

Example 6—the Presence of COR-Encoding Bacteria is Associated with Lower Stool Cholesterol and Elevated Levels of Stool Cholestenone and Coprostanol With a census of COR-encoding bacteria completed, the extent to which the presence of these bacteria in complex microbial communities is associated with coprostanol formation in vivo was evaluated (FIG. 20A). Returning to the two independent cohorts with paired metagenomic and metabolomic data, samples were categorized as either coprostanol positive (converters) or coprostanol negative (non-converters), as determined by the presence of coprostanol in their fecal metabolomes (see methods for details) (Franzosa et al., 2019; Lloyd-Price et al., 2019). In both cohorts, converter samples were strongly enriched in COR-encoding species (PRISM: OR=14.37 (95% CI: 5.41, 44.02); HMP2: OR=40.87 (95% CI: 18.02, 92.72)) (FIG. 20B, Table 10). This supports the hypothesis that the presence of COR-encoding bacteria within a gut microbiota confers the community with the ability to metabolize cholesterol to coprostanol. Interestingly, it was also observed that in a subset of microbial communities without a known COR-encoding microbe, coprostanol was still present (FIG. 20B). This observation might be explained by limit of detection issues with metagenomic sequencing, especially with low abundance microbes, or the possibility that other, more distantly-related microbes can also perform this reaction.

Figure 20C:
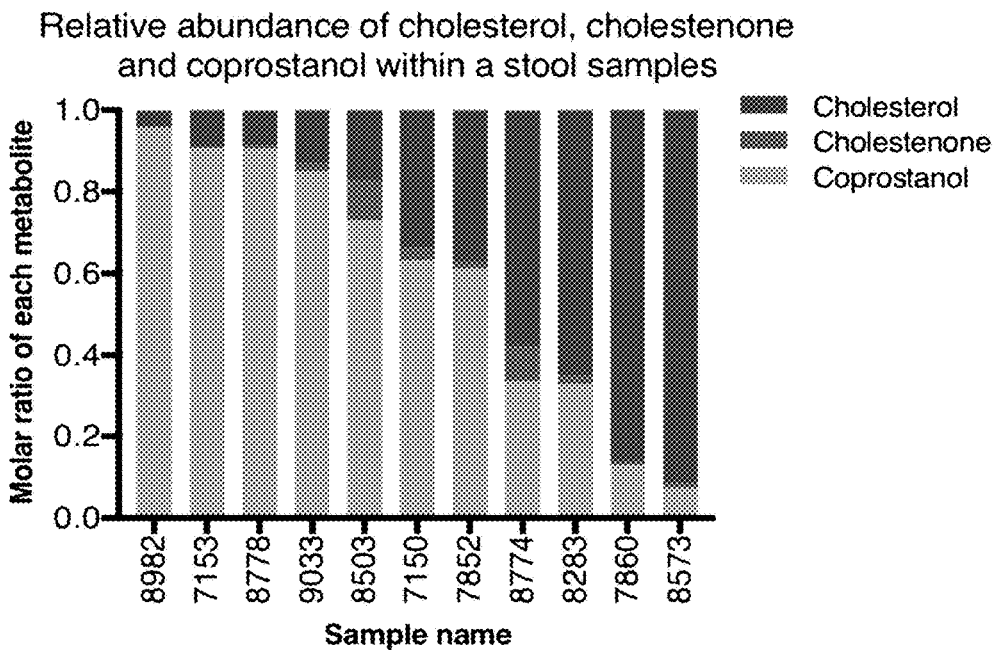

In addition to their association with coprostanol, it was also evaluated whether the presence of a COR-encoding species was correlated with changes in levels of fecal cholesterol and other pathway intermediates identified in the untargeted metabolomics datasets. Strikingly, a 75% and 55% reduction in stool cholesterol in COR-encoders vs. non-encoders was observed in the PRISM and HMP2 cohorts, respectively (FIG. 20C, Table 11). A corresponding increase in levels of stool cholestenone (2) was also observed, with COR-encoders having 5.4-fold and 3.3-fold increases in cholestenone compared to non-encoders in the two cohorts (FIG. 20C, Table 11). These shifts in metabolite levels and their co-occurrence with cor homologs are consistent with our hypothesis that COR-encoding gut bacteria deplete intestinal cholesterol through oxidation of cholesterol to cholestenone, an on-pathway intermediate to coprostanol formation.

Figure 31A:
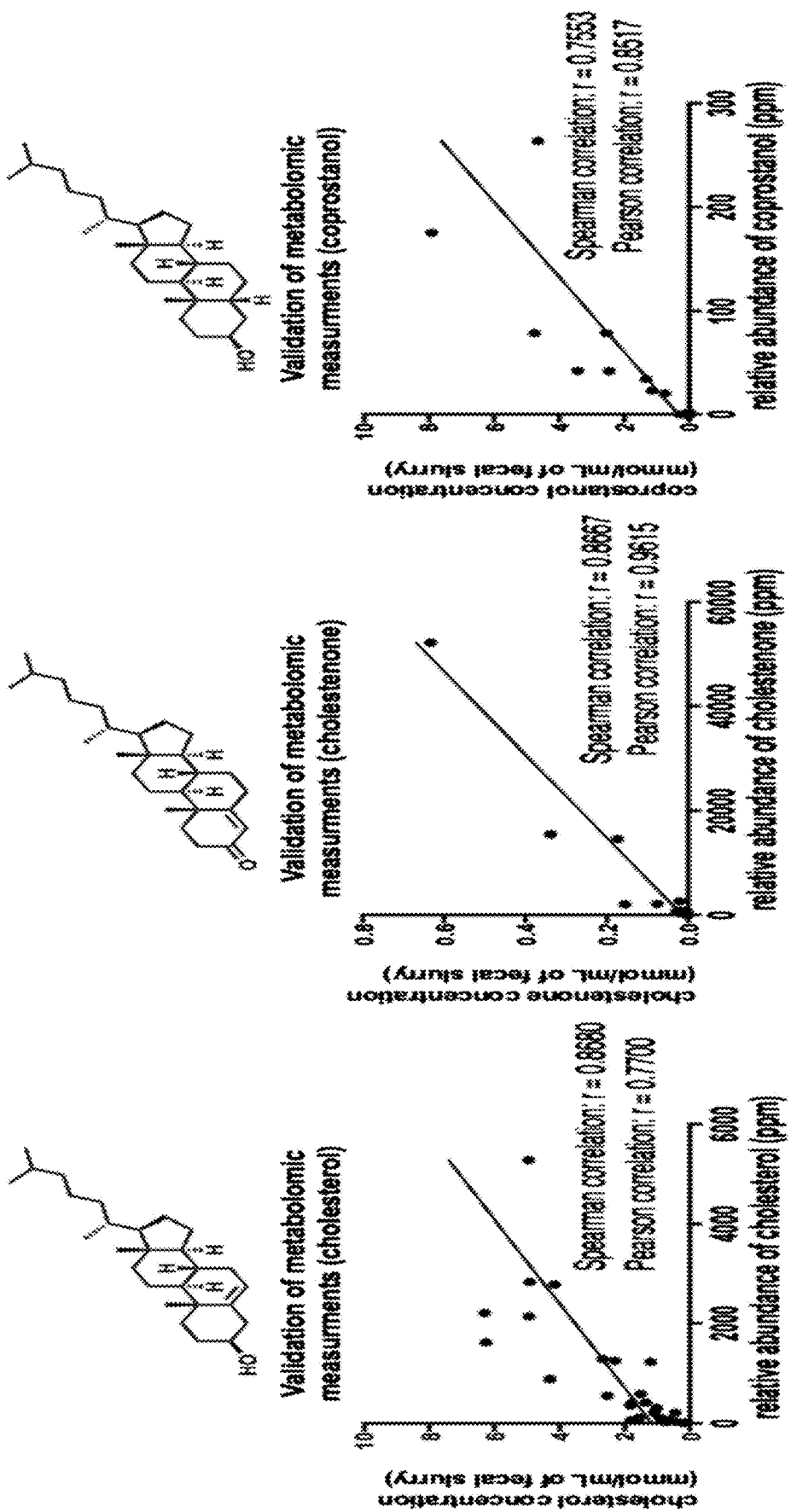
FIG. 31A-31C Quantitative targeted metabolomics of cholesterol, cholestenone and coprostanol in a subset of stool samples from the PRISM cohort.
Figure 31B:
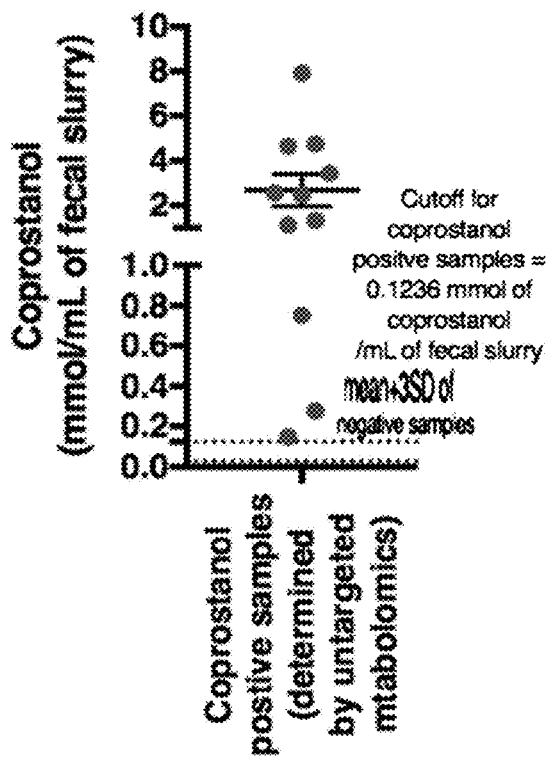
Figure 31C:
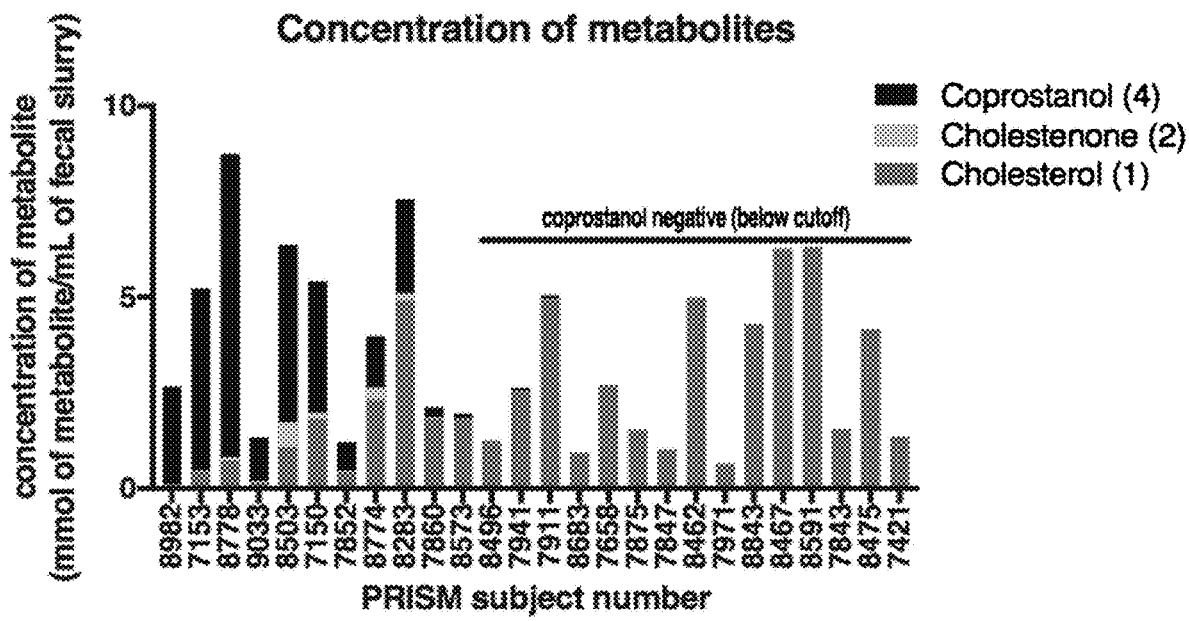

In order to determine the extent of cholesterol metabolism in stool samples where coprostanol is being formed, a subset of 26 samples from the PRISM cohort was re-run using a quantitative LC-MS method. The concentration values for the three metabolites measured (cholesterol, cholestenone, and coprostanol) correlated well with their respective relative abundances determined by previous metabolomic methods in the same samples, validating the quantitative nature of the fecal metabolomics data for our metabolites of interest (FIG. 31A). Using the determined concentrations of each compound within a stool sample, we determined the relative proportion of coprostanol and cholestenone compared to cholesterol was determined (FIGS. 20C, 31B-31C). In the 11 coprostanol-containing human stool samples, the percentage of coprostanol to total measured cholesterol metabolites ranged from 7.4/o to 95.6%, indicating a wide range of activity for this metabolism in vivo (FIG. 20C). Coprostanol comprised greater than 50% of the cholesterol metabolites in 7 of the 11 samples; in 3 of these 7 samples, coprostanol accounted for greater than 90% of the cholesterol metabolites. These data suggest that in some people, this pathway has the potential to convert most of the intestinal cholesterol to coprostanol in vivo.

Example 7—the Presence of COR-Encoding Bacteria is Associated with Lower Levels of Serum Cholesterol Because COR-encoding bacteria are highly associated with both coprostanol formation in human stool samples and decreased fecal cholesterol levels, whether the presence of these coprostanol-forming bacteria was associated with variation in serum lipid levels in human populations, specifically HDL-C, LDL-C, and Total Cholesterol (TC) was examined. To do this in a comprehensive way, three studies (FHS, CVON, JIE et al) were used with paired stool metagenomics and serum cholesterol measurements, comprised of participants from three different countries (USA, Netherlands, China) (Table 12). While CVON (n=292) and JIE et al (n=384) were previously published studies, stool metagenomics data from 623 subjects in the FHS (Framingham Heart Study) cohort was generated to aid in answering this question. The chosen studies also included participants with prevalent cardiovascular disease (CVD). Participants with any of the newly identified COR-encoding bacteria in their microbiome were classified as encoders, while those without these species were considered non-encoders.

In a meta-analysis of these studies, while no statistically significant effects were observed for either LDL-C or HDL-C, a pooled difference of −0.15 mmol/L in TC (95% CI: −0.27, −0.03) was observed between encoders and non-encoders (FIG. 21, Table 13), with directional consistency across all three included studies and low between-study heterogeneity ($I^2=0$). To put the magnitude of the observed decrease in serum cholesterol levels into perspective, the effect sizes of the COR-encoding bacteria (0.15 mmol/L for TC) slightly exceed the largest effects of lipid-associated host genes, such as HMGCR (0.063 SD units per allele for TC, which corresponds to 0.058 mmol/L for the FHS study (see methods for details)) or PCSK9 (0.054 SD units per allele for TC, which corresponds to 0.050 mmol/L per allele for TC for the FHS study) (Willer et al., 2013). Since the presence of these COR-encoding bacteria significantly correlates with a biologically meaningful decrease in total serum cholesterol, it suggests that cholesterol metabolism by the human gut microbiota decreases host cholesterol levels.

Example 8—Discussion Related to Examples 3-7

The idea that gut bacterial metabolism of cholesterol to coprostanol may lower serum cholesterol levels was proposed over 90 years ago, yet relatively few studies have investigated this connection. The paucity of information about this gut microbial metabolic process is especially striking considering the abundance of information regarding other gut microbial metabolic activities, such as secondary bile acid formation and short-chain fatty acid biosynthesis. Efforts to understand the biological implications of gut bacterial cholesterol metabolism have been hindered by the difficulty of culturing the microbes responsible for this activity in humans and a lack of knowledge regarding the biochemical and genetic basis for this metabolic process (Ooi and Liong, 2010). By combining large scale sequencing efforts, reference-free microbiome analysis and a suite of in vitro biochemical and culture-based assays, gut bacterial genes encoding COR enzymes responsible for the first step in coprostanol formation have been identified and characterized. These Examples can at least demonstrate that the majority of coprostanol formation in diverse human populations can be attributed to a clade of highly prevalent, COR-encoding bacterial species. These bacterial species were previously uncharacterized and currently remain uncultured, potentially explaining the past difficulties in studying this metabolic pathway. It was observed that the presence of coprostanol-forming bacteria in stool samples is associated with lower levels of fecal cholesterol, providing a plausible mechanism by which these bacteria may decrease host serum cholesterol levels. This concept is supported by the results of our meta-analysis of three geographically diverse human cohorts, which shows that subjects with coprostanol forming microbes have lower total serum cholesterol.

In addition to the observed correlation with changes in serum lipid levels, the presence of these COR-encoding bacteria is associated with highly elevated levels of intestinal cholestenone and coprostanol. This phenomenon merits further investigation as little is known about the effects of either of these molecules on the host. Metabolites with similar chemical structures, such as bile acids, have large effects on host metabolism and immune regulation, so it is plausible that both cholestenone and coprostanol may also influence host biology (Sinha et al., 2020; Song et al., 2020; Yao et al., 2018). This newfound understanding of which gut bacteria perform this reaction will guide analysis of gut metagenomic datasets to identify additional biological phenomena in which intestinal cholesterol metabolism plays a role. More generally, this work underscores the critical need to link gut microbial metabolic activities to organisms, genes and enzymes in order to fully understand metabolic interactions with the human host (Maini Rekdal et al., 2019).

The effect sizes of the presence of COR-encoding bacteria on serum cholesterol slightly exceeds those associated with differences in human genes, pointing to a potentially protective role for these bacteria in CVD, as is observed for variants of human genes. Since our current cohorts are statistically underpowered to assess the associations between CVD risk and gut microbiome composition, large-scale prospective studies will most likely be required to explore this link. However, since targeting these human genes with therapeutic interventions produces larger effect sizes (for statins targeting HMGCR: on average 1.20 mmol/L on TC), it is possible that modulating the activity of this microbial pathway may lead to similar increases in effect size and additional therapeutic benefit (Law et al., 2003). By introducing cholesterol-metabolizing gut bacteria into human gut microbiotas, or by increasing their abundance with prebiotics, it may be possible to achieve targeted effects on host serum cholesterol, a strategy that has already shown promise in influencing other areas of human metabolism (Holscher, 2017; Kurtz et al., 2019).

Using a multi-disciplinary strategy for enzyme discovery from the human gut microbiome that integrates high-throughput readouts (de novo gene assembly and metabolomics) and biochemical knowledge, enzymes involved in cholesterol metabolism were discovered and characterized. This discovery strategy can also be applied to other pathways/metabolites of interest and can enable further identification and characterization of new enzymes involved in important biological processes contributed by the microbiome, regardless of whether the microbe responsible for this metabolism is known. This is especially important for microbiome studies as computational methods continue to reveal uncharacterized microbes and enzymes that exist in microbial communities across the globe (Almeida et al., 2019; Pasolli et al., 2019). While characterizing 'microbial dark matter' still presents significant challenges, combining bioinformatic and biochemical approaches has the potential to grant access to this largely untapped source of biologically-relevant metabolic transformations (Marcy et al., 2007; Rinke et al., 2013).

Example 9—Materials and Methods for Examples 3-7

Experimental Model and Subject Details
Microbe Strains

*E. coprostanoligenes* ATCC51222 was obtained from the American Type Culture Collection. *E. coprostanoligenes* and stool cultures were grown in basal cholesterol medium (BCM), which contained (per liter) 10 g of casitone (Difco Laboratories, Detroit, Mich.), 10 g of yeast extract, 2 g of cholesterol, 1 g of lecithin, 0.5 g of sodium thioglycolate, 1 g of calcium chloride dihydrate, and 1 mg of resazurin. *E. coprostanoligenes* was grown on modified lecithin agar medium (MLA) plates, which was prepared as described by Freier et al. (Freier et al., 1994).

Cultures were grown and handled in an anaerobic chamber (Coy Laboratory Products) with an atmosphere of 20% $CO_2$, 5% $H_2$, and 75% $N_2$ at 37° C.

Human Subjects

The Framingham Heart Study (FHS) is an observational longitudinal epidemiological investigation of the development of disease as it evolves in a community-based population sample. The design involves serial examination of all Framingham cohorts. The examinations include laboratory testing, physical examination, and interviews. For this study, participants were part of the Generation 3 Cohort who agreed to participate in the microbiome analysis.

The Generation 3 cohort was initially recruited from 2002-2005 and consists of adult men and women who were at least 20 years-old by the close of Generation 3 Exam 1, and who have at least one parent in the FHS Offspring cohort. All participants who came in for Generation 3 exam were informed of the microbiome study. Actual participants were those who returned a sample kit after the visit.

The study protocol was approved by the Massachusetts General Hospital/Partners Human Research Committee and the Institutional Review Board of the Boston University Medical Center. All experiments adhered to the regulations of these review boards. All study procedures were performed in compliance with all relevant ethical regulations. Each participant signed an informed consent prior to participation.

Method Details

Cloning and Expression of Candidate Cholesterol Oxidoreductase Genes.

Candidate cholesterol oxidoreductase genes were amplified from genomic DNA (for *E. coprostanoligenes*) and cloned into pET28b. DNA was extracted from stool samples (DNeasy PowerSoil Kit, Qiagen) (for the cor genes from msp_0238, msp_0205, msp_0421, Table 14) or purchased from Genewiz. PCR reactions were performed with Phusion High Fidelity polymerase, and PCR products were purified (Zymoclean gel DNA recovery kit, Zymo research). The resulting gene products were assembled into pET28b using Gibson assembly and transformed into Stellar™ Competent Cells. The identities of the constructs were confirmed with DNA sequencing and transformed into *E. coli* BL21 strains for expression. All constructs were grown in LB with kanamycin (50 μg/mL) with the exception of the strain expressing the homolog from CAG:180 which required growth in TB for protein expression. All constructs were induced at an $OD_{600}$ of 0.5-0.6 with 500 μM isopropyl β-D-1-thiogalactopyranoside, and the induced cells were incubated at 20° C. for 20 h.

Lysate Experiments for Cholesterol Oxidoreductase Activity 500 mL of a culture of *E. coli* BL21 expressing one of the cholesterol oxidoreductase homologs were pelleted by centrifugation (20 min at 7,000 g and 4° C.), resuspended in 10 mL of ice-cold phosphate-buffered saline containing one cOmplete Protease Inhibitor cocktail tablet (Roche Diagnostics) and lysed by a cell disruptor (EmulsiFlex-C3, Avestin). Cell debris was removed by ultracentrifugation (30 min at 20,000 g and 4° C.). Protein expression was confirmed by SDS-PAGE analysis using 4-20% Mini-PROTEAN TGX gels (Bio-Rad Laboratories). Gels were stained with Coomassie Blue for visualization. The clarified supernatant was used directly in the cell lysate assay described below. Cholesterol or coprostanol (5 μL of a 10 mM solution of cholesterol or coprostanol in methanol) was added to 500 μL of clarified supernatant with 100 μM of $NADP^+$ and $NAD^+$. After incubation at 37° C. for 12 h, the reaction mixtures were frozen until being analyzed using LC-MS.

gPCR of *E. coprostanoligenes*

Total RNA was purified by chloroform-phenol extraction from cell pellets of replicate cultures of *E. coprostanoligenes* grown in basal cholesterol media for 48 h. RNA was DNase treated, and cDNA was prepared using the High-Capacity cDNA Reverse Transcription Kit (Applied Biosystems). Transcripts of interest were quantified by real-time PCR carried out using iTaq Universal SYBR Green Supermix (Bio-Rad). All qPCRs were normalized to 16S rRNA gene expression. Primers used are listed in Table 6.

Purification of N-his Terminal Tagged ECOP170

Proteins were overexpressed using the procedure described above. Cells from 200 mL of culture were pelleted by centrifugation, resuspended in 10 mL of ice-cold lysis buffer (300 mM NaCl, 10 mM imidazole, 50 mM HEPES, pH 7.5) containing one cOmplete Protease Inhibitor cocktail tablet, and lysed by 4 min of continuous passage through a cell disruptor (EmulsiFlex-C3, Avestin) at 15,000 lbs per square inch. Cell debris was removed by ultracentrifugation (20 min at 20,000×g and 4° C.), and the cell-free extract was applied to 0.5 mL of HisPur Ni-NTA Resin (Thermo Scientific) pre-equilibrated with lysis buffer by gentle rocking at 4° C. for 2 h. Non-absorbed materials and weakly bound proteins were removed by washing the column with 2×25 mL of wash buffer (300 mM NaCl, 20 mM imidazole, 50 mM HEPES, pH 7.5). $His_6$-tagged protein was eluted with 5 mL of elution buffer (300 mM NaCl, 200 mM imidazole, 50 mM HEPES, pH 7.5). After SDS-PAGE analysis, eluent containing pure protein was dialyzed (Spectra/Por Dialysis Membrane, 6-8 kDa molecular weight cutoff; Spectrum Labs) against 500 mL of extraction buffer (300 mM NaCl, 50 mM HEPES, pH 7.5) for 12 h at 4° C. The proteins were immediately used in enzymatic assays.

Culturing Stool Samples

Approximately 100 mg of frozen stool sample was suspended in 20 mL of pre-reduced PBS and vortexed for homogenization. 500 μL of stool slurry was added to 5 mL of pre-reduced basal cholesterol medium and cultured in an anaerobic chamber at 37° C.

Extraction of Cholesterol, Cholestenone, Coprostanone and Coprostanol

Samples (either stool cultures, reaction mixtures with purified enzymes or lysates) were diluted 1:10 in methanol. Insoluble debris was removed by centrifugation (10 min at 5,000×g and 4° C.) and the supernatant was injected onto a Kinetex 2.6 μm, C8 100 Å 100×3 mm (Phenomenex) column for LC-MS analysis. For the re-analysis of PRISM stool samples (FIG. 20C), samples post centrifugation were additionally diluted 1:1 in methanol.

Instrumentation and Chromatographic Conditions for Measurement of Sterols

Analysis of the sterols in samples was performed using an ultra-high performance liquid chromatography tandem mass spectrometry (UHPLC-MS/MS) system model Xevo TQ-S (Waters). The mass spectrometer system consists of a triple quadrupole equipped with an atmospheric pressure chemical ionization (APCI) probe. The chromatographic separation was performed on a Kinetex 2.6 μm, C8 100 Å 100×3 mm (Phenomenex) column. The LC elution method was as follows: 0-4.5 min (93% B) at a flow rate of 0.5 mL/min at 40° C. Solvent A was water with 0.1% formic acid, and solvent B was acetonitrile with 0.1% formic acid.

To measure cholesterol, cholestenone, coprostanone and coprostanol, the retention times and mass transitions listed below were monitored for each compound: cholesterol (rt 2.70, 369.332→147.021), cholestenone (rt 2.60, 385.244→108.988), coprostanone (rt 3.00, 369.332→147.021), coprostanol (rt 3.20, 371.304→95.011).

For the targeted metabolomics method developed for the re-analysis of samples from the PRISM cohort, fecal slurries from 26 stool samples were obtained from the metabolomics platform at the Broad Institute (Franzosa et al., 2019). Samples chosen had a large range of relative abundances for coprostanol as determined by untargeted metabolomics. The only difference in analysis was the LC elution method used: 0-23 min (50% B to 100% B), 23-25 min (100% B), 25-29 min (100% B to 50% B), 29-30 min (50% B), at a flow rate of 0.5 mL/min at 40° C. Solvent A was water with 0.1% formic acid, and solvent B was acetonitrile with 0.1% formic acid. To measure cholesterol, cholestenone and coprostanol, the retention times and mass transitions listed below were monitored for each compound: Cholesterol (rt 17.573, 369.332→147.021), cholestenone (rt 17.652, 385.244→108.988), coprostanol (rt 18.899, 371.304→95.011).

Extraction of DNA and Metagenomic Sequencing of Human Stool Samples

For samples used in FIG. 19C, 1 mL of stool culture (described above) at day 3 was centrifuged at 5,000×g for 10 min. Supernatant was removed and the pellet was frozen until further processing. DNeasy PowerSoil Kit was used to isolate DNA (Qiagen).

For Framingham Heart Study (FHS) samples, stool was collected in 100% ethanol for nucleic acid extraction as previously described (Lloyd-Price et al., 2019). For DNA extraction, a combination of the QIAamp 96 PowerFecal Qiacube HT Kit (Qiagen Cat No./ID: 51531), the Allprep DNA/RNA 96 Kit (Qiagen Cat No./ID: 80311), and IRS solution (Qiagen Cat No./ID: 26000-50-2) kits were used with a custom protocol as previously described (Lavoie et al., 2019). Briefly, approximately 100 mg of stool were transferred into individual wells of the PowerBead plate, with 0.1 mm glass beads (Cat No./ID: 27500-4-EP-BP) prior to bead beating on a TissueLyzer II at 20 Hz for a total of 10 minutes. Samples were transferred into AllPrep 96 DNA plate and processed as per manufacturer's instructions. Purified DNA was stored at −20° C.

For metagenomic library construction, DNA samples were first quantified by Quant-iT PicoGreen dsDNA Assay (Life Technologies) and normalized to a concentration of 50 pg/μL. Illumina sequencing libraries were prepared from 100-250 pg of DNA using the Nextera XT DNA Library Preparation kit (Illumina) according to the manufacturer's recommended protocol, with reaction volumes scaled accordingly. Prior to sequencing, libraries were pooled by collecting equal volumes (200 nL) of each library from batches of 96 samples. Insert sizes and concentrations for each pooled library were determined using an Agilent Bioanalyzer DNA 1000 kit (Agilent Technologies). Libraries were sequenced on HiSeq 2500 2×101 to yield ~10 million paired end reads per sample. De-multiplexing and BAM and FASTQ file generation were performed using the Picard suite (broadinstitute.github.io/picard).

Extraction and Sequencing of *E. coprostanoligenes* ATCC51222 and Assembly of High Quality Genome Cultures of *E. coprostanoligenes* were grown for two days in BCM. Cells were pelleted at 5,000×g for 10 min and DNeasy PowerSoil Kit was used to isolate DNA (Qiagen). Two different sequencing methods were used to generate sequencing reads for this genome: Nextera XT DNA Library Preparation kit (Illumina) and Oxford Nanopore MinION. For Illumina library construction, see methods above. The second complementary approach used was Oxford Nanopore MinION sequencing using the 1D approach following default Oxford Nanopore protocols for library preparation. Sequencing of *E. coprostanoligenes* on the MinIon was performed with a R9 flow cell resulting in 9527 reads with an N50 length of 2593. Prior to assembly, the Illumina reads were trimmed with Trimmomatic 0.36. Spades 3.9.0 was used to perform a hybrid assembly with the Illumina and Oxford Nanopore Minion reads using the --nanopore option. The Oxford Nanopore MinIon reads were passed to Spades without correction.

Untargeted Metabolomics of Fecal Samples

Cholesterol (rt 7.21, m/z 369.3519), cholestanone (rt 7.00, m/z 385.3465), and coprostanol (rt 7.50, m/z 371.3583) could be identified in published metabolomics datasets (PRISM and HMP2) using peak picking software (Progenesis QI). For more information detailing the generation of the two fecal metabolomics datasets, see Franzosa et al (Franzosa et al., 2019) and Lloyd-Price et al (Lloyd-Price et al., 2019).

Quantification and Statistical Analysis

Raw sequencing data for PRISM (Franzosa et al., 2019), HMP2 (Lloyd-Price et al., 2019), CVON (Kurilshikov et al., 2019), 500FG (Schirmer et al., 2016) and a study by Jie et al (Jie et al., 2017) were downloaded from SRA: PRJNA400072 (PRISM), PRJNA398089 (HMP2), PRJNA319574 (500FG), or from EBI: EGAS00001003508 (CVON), PRJEB21528 (study by Jie et al).

The quality control for all metagenomic datasets was conducted using Trim Galore! to detect and remove sequencing adapters (minimum overlap of 5 bp) and kneadData v0.7.2 to remove human DNA contamination and trim low-quality sequences (HEADCROP:15 SLIDING-WINDOW:1:20), retaining reads that were at least 50 bp.

A two-step approach was employed to analyze metagenomic data: 1) de-novo assembly, gene catalogue construction and metagenomic species binning to prioritize functionally and taxonomically interesting enzymes correlated with coprostanol detection in stool metabolomics from PRISM (Franzosa et al., 2019) and HMP2 (Lloyd-Price et al., 2019); and 2) targeted assembly across prioritized samples to create draft genomes for human gut microbes that encode the homologs to the prioritized cholesterol oxidoreductase from *E. coprostanoligenes*.

In step 1, metagenomic reads from all cohorts were assembled individually for each sample into contigs using MegaHIT (Li et al., 2015), followed by an open reading frame prediction with Prodigal (Hyatt et al., 2010) and retaining only full length genes (containing both start and stop codon). A non-redundant gene catalogue was constructed by clustering predicted genes based on sequence similarity at 95% identity and 90% coverage of the shorter sequence using CD-HIT (Fu et al., 2012; Qin et al., 2010). Reads were mapped to the gene catalogue with BWA (Li and Durbin, 2009), filtered to include strong mappings with at least 95% sequence identity over the length of the read, counted (count matrix) and normalized to transcript-per-million (TPM matrix). Count matrix served as an input for binning genes into metagenomic species pan-genomes (core and accessory genes) using MSPminer with default settings (Plaza Ofiate et al., 2018). The catalogue at species, genus and phylum levels were annotated with NCBI RefSeq (version May 2018) as described previously (Li et al., 2014). To place MSPs that had no match to any species from NCBI RefSeq on a phylogenetic tree PhyloPhlAn was used with default settings (Segata et al., 2013) and used the support values returned by FastTree (Price et al., 2010) to represent the reliability of each split in the phylogenetic tree (similar to bootstrap values). To perform the sensitivity and specificity analysis for coprostanol detection in stool samples, the gene catalogue was first clustered by grouping proteins with >50% AA identity into clusters of homologous proteins (Suzek et al., 2015) and represented their presence/absence in each sample based on the detection of any protein in the cluster (TPM>0). Clusters of homologous proteins with at least 1% prevalence in PRISM and HMP2 were used, and for each cluster used its detection to classify samples as coprostanol positive (cluster detected) or negative (cluster not detected). By comparing with the actual metabolomics readout of coprostanol presence or absence in each stool sample, measures of sensitivity (true positives/(true positives+false negatives)) and specificity (true negatives/(true negatives+false positives)) were derived for each cluster that represent how well a given cluster correlates with presence and absence of coproprostanol. Proteins found in the microbial genomes of interest: *B. dorei* CL03T12C01 (GCF_001640865.1), *B. longum* NCC2705 (GCF_000007525.1) and *Lactobacillus acidophilus* ATCC 53544 (CP022449.1), were mapped to the clusters of homologous proteins with USEARCH ublast (Edgar, 2010) (min. 50% AA identity, 50%). Similarly, USEARCH ublast (Edgar, 2010) was used to map enzymes of interest (Table 4) to the clusters of homologues, but with a more inclusive similarity cutoffs (min. 25% AA identity, 50% coverage).

In step 2, for the prioritized MSPs human gut microbiomes were selected (at least two per MSP) that had the highest cumulative read-per-kilobase (RPK) count across all MSP genes (counted in step 1) for assembly with SPAdes (Bankevich et al., 2012) in '--meta' mode. The 4 cultured stool samples were that showed cholesterol oxidoreductase activity were included. 6 samples were aborted after two assembly trials due to expected very long runtime (>>48 h), and in their case, were reverted to the MegaHIT assemblies from step 1. To construct the draft genomes, genes binned in the respective MSPs (from step 1) were used to find (min. 95% identity, min. 50% coverage, USEARCH ublast (Edgar, 2010)) and extract contigs encoding them. The quality of the draft genomes were evaluated using completeness and contamination measurements based on lineage specific marker genes with CheckM ('lineage_wf' workflow) (Parks et al., 2015). As recommended by CheckM framework, draft genomes with >90% completeness and <5% contamination were considered as near complete (high quality draft genomes) (Parks et al., 2015). Additionally, draft genomes with >50% completeness and <10% contamination were defined as medium quality (Bowers et al., 2017). All-vs-all genome-wide calculation of sequence identity for the draft genomes and the genome of *E. coprostanoligenes* was performed with FastANI (Jain et al., 2018).

Figure 29A:
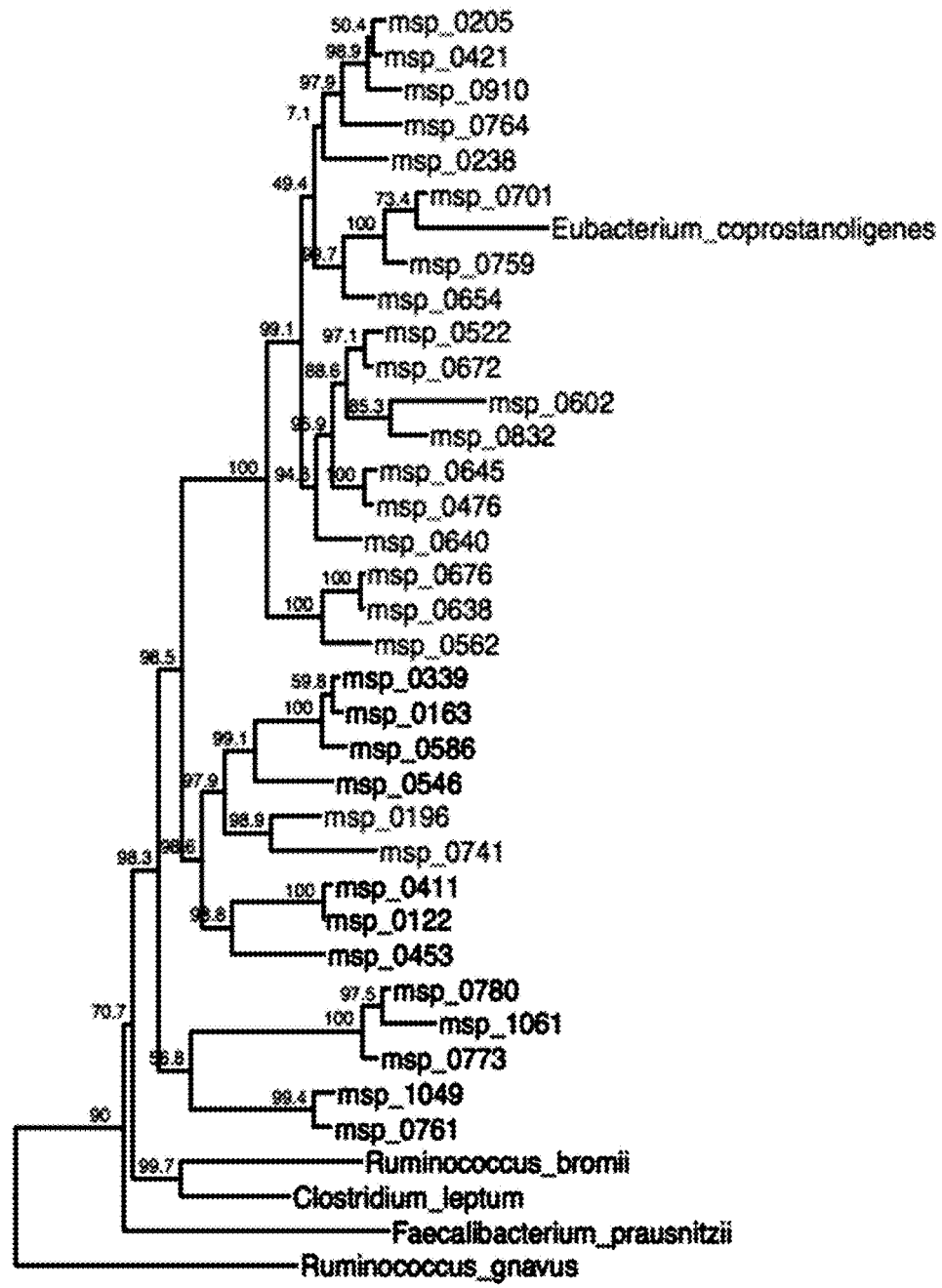
FIG. 29A-29C COR encoding species identified across 6 human cohorts.
Figure 29B:
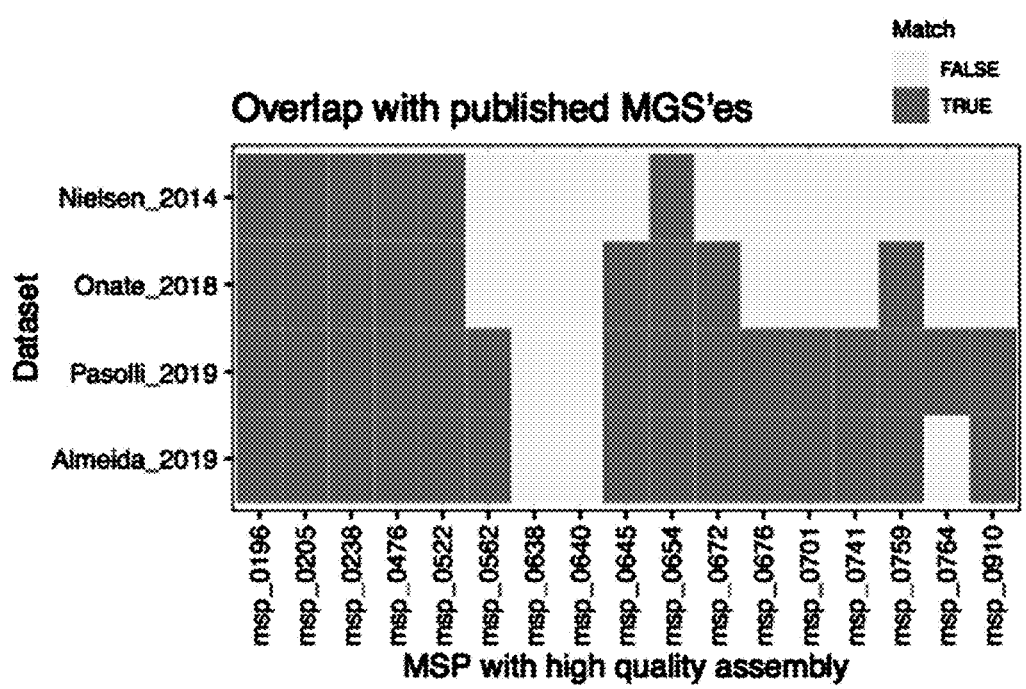
Figure 29C:
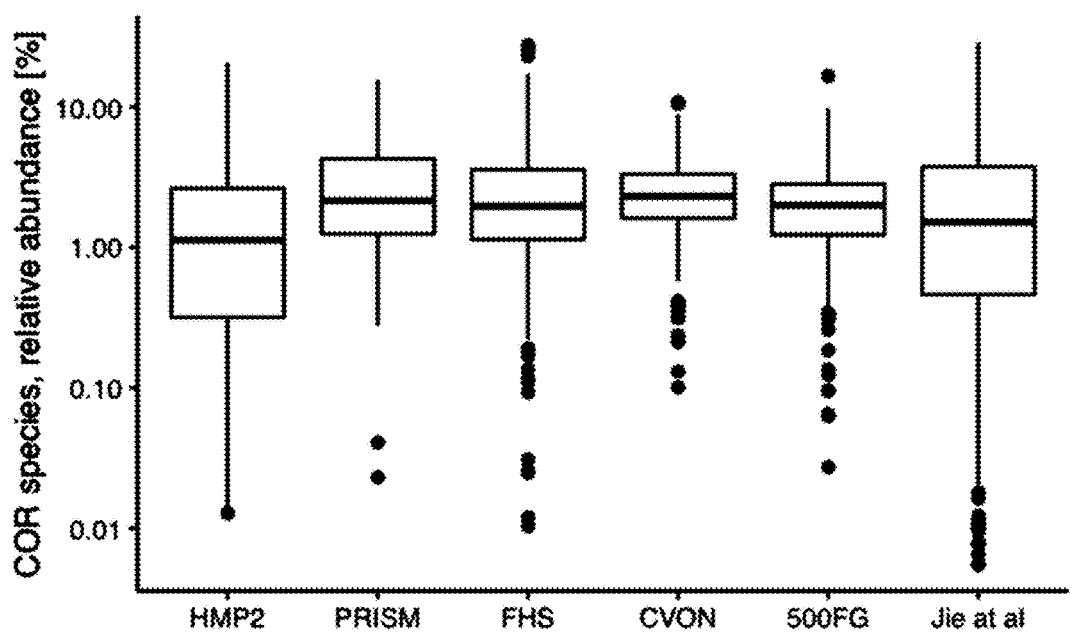

To test for detection of *E. coprostanoligenes* in the human gut microbiome, its genes were searched for in the assembled gene catalogue (min. 95% identity, USEARCH global alignment (Edgar, 2010)) or mapped metagenomic stool samples (as in step 1 above) to the assembled gene catalogue that was augmented with the *E. coprostanoligenes* genes (only added genes with less than 95% identity to other genes in the gene catalogue, USEARCH global alignment (Edgar, 2010)). In order to link the near quality draft genomes for COR encoding MSPs to the previous studies, their genes were searched for near identical hits among gene sets from metagenomic species (MGS'es) generated in two gene-centric studies (Nielsen et al., 2014); (Plaza Oiate et al., 2018) and two genome-binning studies (Pasolli et al., 2019); (Almeida et al., 2019) using global alignment (min. 95% nucleotide identity, USEARCH (Edgar, 2010)). MGS was matched to a COR-encoding MSP if an overlap with at least. 50% genes was observed (FIG. 29B, Table 9).

The high-quality draft genomes are available for download from NCBI Genomes Bioproject PRJNA559861.

Associations with Blood Lipids and Meta-Analysis of Four Studies

The relationship between converter status and blood concentration of total cholesterol, LDL-C and HDL-C was studied in three studies with publicly available shotgun metagenomic sequencing datasets: CVON (Kurilshikov et al., 2019), a study by JIE et al (Jie et al., 2017) and one newly sequenced FHS study. Detailed characteristics of studies are provided in Table 12.

Converter status was coded as a dichotomous variable (converter cases and controls (="non-converter")). LDL levels were calculated using Friedewald equation (Friedewald et al., 1972) [LDL=TC−HDL−(TG/5)). Triglycerides were not normally distributed and thus a log 10 transformation was performed.

In each study association analysis was performed using a generalized linear model with a given lipid as outcome and encoder status as a predictor. Age (in years), sex, antibiotic usage (yes/no) and statin usage (yes/no) were fitted as covariates while optimization was performed using lm function in R. CVD status (yes/no) was additionally included in the model in all studies with available data (CVON and FHS). All participants of the JIE et al. study were not taking antibiotics (Jie et al., 2017). For the Jie et al. study, statin usage was not reported for controls and thus only CVD cases were used in our analyses to avoid confounding of associations due to profound effects of statins on lipid concentrations.

Inverse variance-weighted random-effects meta-analysis implemented in meta R package was used to obtain pooled estimates for relationship between converter status and lipid concentrations across all three studies with between-study heterogeneity calculated using P statistics (Higgins and Thompson, 2002) (also meta R package).

Relationships Between Stool Metabolites and Converter Status

Relationships between stool metabolites and converter status were investigated in the PRISM (Franzosa et al., 2019) and HMP2 (Lloyd-Price et al., 2019) studies. In PRISM and HMP2, data for cholesterol, cholestenone and coprostanol was available. Log 10 transformation was performed (with pseudo count of 1e-5 for zero values) of metabolite data followed by calculation of z-scores by subtracting the mean from each individual value and dividing by the standard deviation. For coprostanol, dichotomous variable indicating presence or absence of this metabolite in stool samples was also created.

In PRISM, transformed resealed values of metabolites were used as outcomes in linear regression models using lm function (stats package in R), converter status was included as predictor, while age, gender, antibiotic usage (yes/no) and disease status (non-IBD, CD or UC) were used as covariates. For the dichotomous coprostanol variable the same model specification was utilized, but applied a logistic model using glm function (stats package in R).

Given that in the HMP2 study longitudinal metabolite measurements were available, mixed effects models were utilized to study relationships between converter status and stool metabolite concentrations. Transformed metabolite values were fitted as outcomes and converter status was specified as predictor while subjects were included as random effects to account for correlation between repeated measures (lme function from nlme R package). For the dichotomous coprostanol variable a logistic mixed effects model including subjects as random effects variable (glmer function from lme4 package in R) was fitted. Age, gender, antibiotic usage (yes/no) and disease status (non-IBD, CD or UC) were included in all models as covariates (fixed effects) in HMP2 study.

Comparison with GWAS Meta-Analysis for Lipid Traits

Two loci were selected that are known drug targets (HMGCR and PCSK9) and extracted respective effect sizes from the largest GWAS meta-analysis (Willer et al., 2013) to compare with the effects of the studied cor microbial genes. To make GWAS estimates in SD units comparable with reported effect sizes, beta values from GWAS were multiplied by SD from FHS study. For example, SD of lipid of interest from the FHS cohort (e.g., 0.92 mmol/L for TC) was multiplied by the effect size per allele in SD units (e.g., 0.068 in SD units for HMGCR) to give the effect size in mmol/L (e.g., 0.063 mmol/L per allele in FHS study for HMGCR).

Data and Code Availability

PRISM and HMP2 metabolomics data (accession number PR000677 and PR000639 respectively) are available at the NIH Common Fund's Metabolomics Data Repository and Coordinating Center (supported by NIH grant, U01-DK097430): Metabolomics Workbench (metabolomics-workbench.org). Framingham Heart Study metagenomics data is available in the Sequence Read Archive (ncbi.nlm.nih.gov/sra) under BioProject PRJNA559860. Stool culture sequencing data can be found under BioProject PRJNA559861.

REFERENCES FOR EXAMPLES 3-9

References as noted in Examples 3-9 are set forth below and are incorporated by reference as if expressed herein in their entirety.

Almeida A, Mitchell A L, Boland M, et al. (2019) A new genomic blueprint of the human gut microbiota. Nature 568(7753): 499-504.

Bankevich A, Nurk S, Antipov D, et al. (2012) SPAdes: a new genome assembly algorithm and its applications to single-cell sequencing. Journal of computational biology: a journal of computational molecular cell biology 19(5): 455-477.

Bays H E, Neff D, Tomassini J E, et al. (2008) Ezetimibe: cholesterol lowering and beyond. Expert review of cardiovascular therapy 6(4): 447-470.

Björkhem I and Gustafsson J A (1971) Mechanism of microbial transformation of cholesterol into coprostanol. European journal of biochemistry/FEBS 21(3): 428-432.

Bowers R M, Kyrpides N C, Stepanauskas R, et al. (2017) Minimum information about a single amplified genome (MISAG) and a metagenome-assembled genome (MIMAG) of bacteria and archaea. Nature biotechnology 35(8): 725-731.

Chiang J Y L (2009) Bile acids: regulation of synthesis. Journal of lipid research 50(10): 1955-1966.

Chiang Y-R, Ismail W, Heintz D, et al. (2008) Study of Anoxic and Oxic Cholesterol Metabolism by *Sterolibacterium denitrificans*. Journal of bacteriology 190(3): 905-914.

Devlin A S and Fischbach M A (2015) A biosynthetic pathway for a prominent class of microbiota-derived bile acids. Nature chemical biology 11(9): 685-690.

Edgar R C (2010) Search and clustering orders of magnitude faster than BLAST. Bioinformatics 26(19): 2460-2461.

Eyssen H J, Parmentier G G, Compernolle F C, et al. (1973) Biohydrogenation of sterols by *Eubacterium* ATCC 21,408—Nova species. European journal of biochemistry/FEBS 36(2): 411-421.

Forster S C, Kumar N, Anonye B O, et al. (2019) A human gut bacterial genome and culture collection for improved metagenomic analyses. Nature biotechnology 37(2): 186-192.

Franzosa E A, Sirota-Madi A, Avila-Pacheco J, et al. (2019) Gut microbiome structure and metabolic activity in inflammatory bowel disease. Nature microbiology 4(2): 293-305.

Freier T A, Beitz D C, Li L, et al. (1994) Characterization of *Eubacterium coprostanoligenes* sp. nov., a cholesterol-reducing anaerobe. International journal of systematic bacteriology 44(1): 137-142.

Friedewald W T, Levy R I and Fredrickson D S (1972) Estimation of the concentration of low-density lipoprotein cholesterol in plasma, without use of the preparative ultracentrifuge. Clinical chemistry 18(6): 499-502.

Fu J, Bonder M J, Cenit M C, et al. (2015) The Gut Microbiome Contributes to a Substantial Proportion of the Variation in Blood Lipids. Circulation research 117(9): 817-824.

Fu L, Niu B, Zhu Z, et al. (2012) C D-HIT: accelerated for clustering the next-generation sequencing data. Bioinformatics 28(23): 3150-3152.

Gerard P, Lepercq P, Leclerc M, et al. (2007) *Bacteroides* sp. Strain D8, the First Cholesterol-Reducing Bacterium Isolated from Human Feces. Applied and environmental microbiology 73(18): 5742-5749.

Goldstein J L and Brown M S (2015) A century of cholesterol and coronaries: from plaques to genes to statins. Cell 161(1): 161-172.

Higgins J P T and Thompson S G (2002) Quantifying heterogeneity in a meta-analysis. Statistics in medicine 21(11): 1539-1558.

Holscher H D (2017) Dietary fiber and prebiotics and the gastrointestinal microbiota. Gut microbes 8(2): 172-184.

Hyatt D, Chen G-L, Locascio P F, et al. (2010) Prodigal: prokaryotic gene recognition and translation initiation site identification. BMC bioinformatics 11: 119.

Jain C, Rodriguez-R L M, Phillippy A M, et al. (2018) High throughput ANI analysis of 90K prokaryotic genomes reveals clear species boundaries. Nature communications 9(1): 5114.

Jie Z, Xia H, Zhong S-L, et al. (2017) The gut microbiome in atherosclerotic cardiovascular disease. Nature communications 8(1): 845.

Koppel N, Maini Rekdal V and Balskus E P (2017) Chemical transformation of xenobiotics by the human gut microbiota. Science 356(6344). DOI: 10.1126/science.aag2770.

Kreit J and Sampson N S (2009) Cholesterol oxidase: physiological functions. The FEBS journal 276(23): 6844-6856.

Kriaa A, Bourgin M, Potiron A, et al. (2019) Microbial impact on cholesterol and bile acid metabolism: current status and future prospects. Journal of lipid research 60(2): 323-332.

Kurilshikov A, van den Munckhof I C L, Chen L, et al. (2019) Gut Microbial Associations to Plasma Metabolites Linked to Cardiovascular Phenotypes and Risk. Circulation research 124(12): 1808-1820.

Kurtz C B, Millet Y A, Puurunen M K, et al. (2019) An engineered *E. coli* Nissle improves hyperammonemia and survival in mice and shows dose-dependent exposure in healthy humans. Science translational medicine 11(475). DOI: 10.1126/scitranslmed.aau7975.

Lavoie S, Conway K L, Lassen K G, et al. (2019) The Crohn's disease polymorphism, ATG16L1 T300A, alters the gut microbiota and enhances the local Th1/Th17 response. eLife 8. DOI: 10.7554/eLife.39982.

Law M R, Wald N J and Rudnicka A R (2003) Quantifying effect of statins on low density lipoprotein cholesterol, ischaemic heart disease, and stroke: systematic review and meta-analysis. BMJ 326(7404). bmj.com: 1423.

Le Roy T, Lécuyer E, Chassaing B, et al. (2019) The intestinal microbiota regulates host cholesterol homeostasis. BMC biology 17(1): 94.

Li D, Liu C-M, Luo R, et al. (2015) MEGAHIT: An ultra-fast single-node solution for large and complex metagenomics assembly via succinct de Bruijn graph. Bioinformatics 31(10): 1674-1676.

Li H and Durbin R (2009) Fast and accurate short read alignment with Burrows-Wheeler transform. Bioinformatics 25(14): 1754-1760.

Li J, Jia H, Cai X, et al. (2014) An integrated catalog of reference genes in the human gut microbiome. Nature biotechnology 32(8). Nature Publishing Group, a division of Macmillan Publishers Limited. All Rights Reserved.: 834-841.

Lloyd-Price J, Arze C, Ananthakrishnan A N, et al. (2019) Multi-omics of the gut microbial ecosystem in inflammatory bowel diseases. Nature 569(7758): 655-662.

Lopetuso L R, Scaldaferri F, Petito V, et al. (2013) Commensal Clostridia: leading players in the maintenance of gut homeostasis. Gut pathogens 5(1): 23.

Lye H-S, Rusul G and Liong M-T (2010) Removal of cholesterol by lactobacilli via incorporation and conversion to coprostanol. Journal of dairy science 93(4): 1383-1392.

Maini Rekdal V, Bess E N, Bisanz J E, et al. (2019) Discovery and inhibition of an interspecies gut bacterial pathway for Levodopa metabolism. Science 364(6445). DOI: 10.1126/science.aau6323.

Marcy Y, Ouverney C, Bik E M, et al. (2007) Dissecting biological 'dark matter' with single-cell genetic analysis of rare and uncultivated TM7 microbes from the human mouth. Proceedings of the National Academy of Sciences of the United States of America 104(29): 11889-11894.

Mott G E and Brinkley A W (1979) Plasmenylethanolamine: growth factor for cholesterol-reducing *Eubacterium*. Journal of bacteriology 139(3): 755-760.

Nielsen H B, Almeida M, Juncker A S, et al. (2014) Identification and assembly of genomes and genetic elements in complex metagenomic samples without using reference genomes. Nature biotechnology 32(8): 822-828.

Nordestgaard B G and Varbo A (2014) Triglycerides and cardiovascular disease. The Lancet 384(9943). Elsevier: 626-635.

Norin K E, Persson A K, Saxerholt H, et al. (1991) Establishment of *Lactobacillus* and *Bifidobacterium* species in germfree mice and their influence on some microflora-associated characteristics. Applied and environmental microbiology 57(6): 1850-1852.

Ooi L-G and Liong M-T (2010) Cholesterol-lowering effects of probiotics and prebiotics: a review of in vivo and in vitro findings. International journal of molecular sciences 11(6): 2499-2522.

Park S, Kang J, Choi S, et al. (2018) Cholesterol-lowering effect of *Lactobacillus rhamnosus* BFE5264 and its influence on the gut microbiome and propionate level in a murine model. PloS one 13(8): e0203150.

Parks D H, Imelfort M, Skennerton C T, et al. (2015) CheckM: assessing the quality of microbial genomes recovered from isolates, single cells, and metagenomes. Genome research 25(7): 1043-1055.

Parmentier G and Eyssen H (1974) Mechanism of biohydrogenation of cholesterol to coprostanol by *Eubacterium* ATCC 21408. Biochimica et biophysica acta 348(2). Elsevier: 279-284.

Pasolli E, Asnicar F, Manara S, et al. (2019) Extensive Unexplored Human Microbiome Diversity Revealed by Over 150,000 Genomes from Metagenomes Spanning Age, Geography, and Lifestyle. Cell 176(3): 649-662.e20.

Plaza Oiate F, Le Chatelier E, Almeida M, et al. (2018) MSPminer: abundance-based reconstitution of microbial pan-genomes from shotgun metagenomic data. Bioinformatics. DOI: 10.1093/bioinformatics/bty830.

Price M N, Dehal P S and Arkin A P (2010) FastTree 2—Approximately Maximum-Likelihood Trees for Large Alignments. Poon A F Y (ed.) PloS one 5(3). Public Library of Science: e9490.

Qin J, Li R, Raes J, et al. (2010) A human gut microbial gene catalogue established by metagenomic sequencing. Nature 464(7285): 59-65.

Rader D J and Hovingh G K (2014) HDL and cardiovascular disease. The Lancet 384(9943). Elsevier: 618-625.

Ren D, Li L, Schwabacher A W, et al. (1996) Mechanism of cholesterol reduction to coprostanol by *Eubacterium coprostanoligenes* ATCC 51222. Steroids 61(1): 33-40.

Rinke C, Schwientek P, Sczyrba A, et al. (2013) Insights into the phylogeny and coding potential of microbial dark matter. Nature 499(7459): 431-437.

Rosenfeld BYRS, Fukushima D K, Hellman L, et al. (1954) The transformation of cholesterol to coprostanol. Journal of Biological Chemistry.

Rothschild D, Weissbrod O, Barkan E, et al. (2018) Environment dominates over host genetics in shaping human gut microbiota. Nature 555(7695): 210-215.

Rowland I, Gibson G, Heinken A, et al. (2018) Gut microbiota functions: metabolism of nutrients and other food components. European journal of nutrition 57(1): 1-24.

Sadzikowski M R, Sperry J F and Wilkins T D (1977) Cholesterol-reducing bacterium from human feces. Applied and environmental microbiology 34(4): 355-362.

Santoru M L, Piras C, Murgia A, et al. (2017) Cross sectional evaluation of the gut-microbiome metabolome axis in an Italian cohort of IBD patients. Scientific Reports. DOI: 10.1038/s41598-017-10034-5.

Schirmer M, Smeekens S P, Vlamakis H, et al. (2016) Linking the Human Gut Microbiome to Inflammatory Cytokine Production Capacity. Cell 167(4): 1125-1136.e8.

Segata N, Börnigen D, Morgan X C, et al. (2013) PhyloPhlAn is a new method for improved phylogenetic and taxonomic placement of microbes. Nature communications 4: 2304.

Sinha S R, Haileselassie Y, Nguyen L P, et al. (2020) Dysbiosis-Induced Secondary Bile Acid Deficiency Promotes Intestinal Inflammation. Cell host & microbe. Elsevier. DOI: 10.1016/j.chom.2020.01.021.

Song X, Sun X, Oh S F, et al. (2020) Microbial bile acid metabolites modulate gut RORγ+ regulatory T cell homeostasis. Nature 577(7790). nature.com: 410-415.

Sundqvist T, Stenhammar L, Tjellström B, et al. (2019) Evidence of Disturbed Gut Microbial Metabolic Activity in Pediatric Crohn's Disease. Crohn's & Colitis 360. DOI: 10.1093/crocol/otz010.

Suzek B E, Wang Y, Huang H, et al. (2015) UniRef clusters: a comprehensive and scalable alternative for improving sequence similarity searches. Bioinformatics 31(6): 926-932.

Vatanen T, Plichta D R, Somani J, et al. (2019) Genomic variation and strain-specific functional adaptation in the human gut microbiome during early life. Nature microbiology 4(3): 470-479.

Whitman W B, Rainey F, Kämpfer P, et al. (eds) (2015) Eubacteriaceae fam. nov. In: Bergey's Manual of Systematics of Archaea and Bacteria. Chichester, UK: John Wiley & Sons, Ltd, pp. 1-1.

Willer C J, Schmidt E M, Sengupta S, et al. (2013) Discovery and refinement of loci associated with lipid levels. Nature genetics 45(11): 1274-1283.

Yang X, Dubnau E, Smith I, et al. (2007) Rv1106c from *Mycobacterium tuberculosis* is a 3beta-hydroxysteroid dehydrogenase. Biochemistry 46(31): 9058-9067.

Yao L, Seaton S C, Ndousse-Fetter S, et al. (2018) A selective gut bacterial bile salt hydrolase alters host metabolism. eLife 7. elifesciences.org. DOI: 10.7554/eLife.37182.

Zou Y, Xue W, Luo G, et al. (2019) 1,520 reference genomes from cultivated human gut bacteria enable functional microbiome analyses. Nature biotechnology 37(2): 179-185.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (1930 sequences)

SEQ ID NO: 1 - protein, 278 aa, Artificial Sequence
  Synthetic
MDKNWLNFKTVIVTGASSGMGKGIAEKLIKEHGCTVIGVARSEQKMQKFVEELGEYKDRFSYQLFDVSSLENWENFRKYLEDNRIQPDILINNAGILPKFDKFQHYTIEEIERAMNINFYSAVYSMHILLPLLLKSPSAAIINVDSSASLMSLAGTSVYSASKSALKSLTESLREELRGKCYVGIVCPGFTKTDIFRNQGSSDEKAQKMLNMVSTSCDKMVKLIMHGVGNQRELMVFGKDAAFMNYFGRIMPVLGGRLFSAVMKMSKLPLFDGVFKED

SEQ ID NO: 2 - protein, 277 aa, Artificial Sequence
  Synthetic
MNTNWMNNKTVIITGASGGMGKGVAERLIKEHGCTVIGIARSEEKMKKVVEELGEYADKFSYQLFDVSVEQNWIDFVTYLRDNNIHPDVLINNAGILPKFDRFQNYTIDYIKKAMDINFYSAVYSIHALLPVLLESSTPAIINVDSSAALMTLAGTSVYSASKAALKSLSEALREELRGKCYVGIVCPGFTKTDIFRDQSSTDDKGTKMLNAVSTPCDKMVNMIMRDIKLKRPLGVHGFDAAFMNYFGRIMPVQGGRLFSTVMKVSKLPLFDPVFKD

SEQ ID NO: 3 - protein, 277 aa, Artificial Sequence
  Synthetic
MDQNWMNNTTVIVTGASGGMGKGIAESLIVDHGCTVIGIARSEEKMKKVVEELGPNAEKFSYKLFDVSVEQNWIDFAKYLEDNDIHPDILVNNAGILPKFDRFEHYSMADIEKAMNINFYSAVYSIHTLLPMILKSKTPGIINIDSSASLMSLAGTSVYSASKAALKSLSESLREELRGKCYVGIVCPGFTKTDIFRSQDASDAKGQKMLNAVSTSCDRMVKMIMHDIRTRRPLGVHGFDAAFMNYFGRLMPVLGGHIFSSVMKISKLPLFDPVFKD

SEQ ID NO: 4 - protein, 274 aa, Artificial Sequence
  Synthetic
MWMQGKTVVITGASSGMGKGIAQRLIVDYGCNVIGIARSEQKMKKFVEELGFYAGKFSYRLFDVSVRENWENFAAELKENGTKIDVLINNAGILPKFKRFDRYTIEDIENVMNINFYSAVYGSKILFDQLMESDTPAIINVDSSAALMALAGTSAYSASKSALKSLTEAMREEYRGKMYIACVCPGFTKTDIFRNQGETSGKGEKAMNMISTDCDKMVDMIVRGIAHHKALQVHGKDAFFMDVFSRLLPVNGPRLFSNVMRMAKLDLFDGVFKD

SEQ ID NO: 5 - protein, 274 aa, Artificial Sequence
  Synthetic
MWMQGKTVVITGASSGMGKGIAEKLIKEYGCNVIGVARSEVKMKKFVEELGFYAGKFSYELFDVSVKENWEKFSQQLKDNGTKIDVLINNAGILPKFMRFDRCSIEDIEKVMNINFYSAVYGSKYLFDQLMESDTPAIINVDSSAALMSLAGTSAYSASKSALKSLSEAMREEYRGKMYVGIVCPGFTKTDIFRNQGETSGKGQKVMNMISTDCDKMVKMIVNGIAHQKALQVHGKDAWAMDIFGKLLPVNGSRLFSSVMRMANIDLFDGVFKD

SEQ ID NO: 6 - protein, 274 aa, Artificial Sequence
  Synthetic
MWMQGKTVVITGASSGMGKGIAEKLIKEYGCNVIGVARSEAKMKKFVEELGFYAGKFSYQLFDVSVKENWEKFSQQLKDNGTKIDVLINNAGILPKFMRFDRCSIEDIEKVMNINFYSAVYGSKYLFDQLMESDTPAIINVDSSAALMSLAGTSAYSASKSALKSLSEAMREEYRGKMYVGIVCPGFTKTDIFRNQGETSGKGQKVMNMISTDCDKMVKMIVNGIAHQRALQVHGKDAWAMDIFGKLLPVNGSRLFSSVMRMANIDLFDGVFKD

SEQ ID NO: 7 - protein, 278 aa, Artificial Sequence
  Synthetic
MACWLDGKTVVVTGASGGMGAGIAATLIKKHGCTVIGIARSEPKMLKFIDELGPTYASQFSYKLFDVSIKENWENFAQELQDNDTKIDILINNAGILPKFKRFDRYSYDEIEKAMNINFYSCIYSTKTLLPMLLESPTPGVINIDSSAALMTLAGTSMYSASKAALKGFTEALRVEFQGKMYVSLVCPGFTKTDIFRDQGTESNSKGQKVMDMISTDCDLMVKMIMKGIEFKAPMQVHGLDAHAMSICNRIAPVYGSKLFSAVMRMANVDIFKEVFND

SEQ ID NO: 8 - protein, 279 aa, Artificial Sequence
  Synthetic
MNECWLHGKTVVVTGASGGMGAGIAGTLIKKHGCTVIGVARNEKKMLKFIDELGDSYAKQFSYKLFDVSKKENWENFYQELRDNGVKVDILINNAGILPKFKRFDKYSYEEIDMAMNINFYSSVYSVKTMLPMLLESSTPAVINIDSSAALMTLAGTSMYSASKAALKGFTEALRIEFKDKMYVGLVCPGFTKTDIFRGQTGVNMDSGAKAMDMISTDCDKMVKMIMFGIEHKMPMQVHGFDAHAMSVANRLMPVYGSKLFSAVMRMANVDIFKEVFSD

SEQ ID NO: 9 - protein, 279 aa, Artificial Sequence
  Synthetic
MNTCWLQGKTVVVTGASGGMGAGIAATLIKKHGCTVIGVARNEKKMLHFIEELGETYAKQFSYELFDVSVKENWENFANELNEKGIKVDILINNAGILPKFKRFDKYSYDEIERAMNINFYSCVYSVKTMLPMLLKSSTPAIINIDSSAALMTLAGTSMYSASKAALKGFTEALRVEFQGKMYVGLVCPGFTKTDIFSGQGDADMSSGAKVMDMISTDCDKMVKMIMFGIEHKAPMQVHGFDAHAMSVFNRLMPVYGSKLFSSVMRMANVDIFKEVFSD

SEQ ID NO: 10 - protein, 279 aa, Artificial Sequence
  Synthetic
MSTCWLQGKTVVVTGASGGMGAGIAATLIKKHGCTVIGVARNEKKMLKFVDELGETYAKQFSYELFDVSSKENWEKFAEELQEKGVKVDVLINNAGILPKFKRFDRYSYEEIDRAMNINFYSCVYSVKTMLPMLLQSSTPAIINIDSSAALMTLAGTSMYSASKAALKGFTEALRVEFQGKMFVGLVCPGFTKTDIFSGQGDADMSNGAKVMDMISTDCDKMVKMIMFGIEHKTPMQVHGFDAHAMSVFNRLMPVYGSKLFSSIMRMANVDIFKEVFSD

SEQ ID NO: 11 - protein, 285 aa, Artificial Sequence
  Synthetic
MSDCKCCVGGDWLSGKTVIVTGASGGMGAGIAATLIKKHACRVVGVARSETKMLKFIEELGPTYAEQFSYKLFDVSDKAAWESFAEELAEEGIRPSVLINNAGILPKFKRFDRYSYEEIERAMNINFYSCVYGVKTFLPVLLEEEDPAIINVDSSAALMTLAGTSMYSASKAALKGFTEALRVEFKNKMYVGLVCPGFTKTDIFRDQKNEGGKGQKVMDMISTDCDLMVKMIMFGIAHKRPMMVHGLDAHAMSVFNRLLPVKGSELFSLVMKVADIDLFNDVFKD

SEQ ID NO: 12 - protein, 285 aa, Artificial Sequence
  Synthetic
MSNCTNAICGDWLNGKTVIVTGASGGMGAGIAATLIKKHNCRVVGVARNEAKMLKFIEELGPMYKDQFSYKLFDVSSREAWENFAKELEEEGIVPSVLVNNAGILPKFKRFDRYSYDEIERAMNINFYSCVYGVKTFLPVLLTQDDPGIINVDSSAALMTLAGTSMYSSSKAALKGFTEALRVEFKGKCYVGLVCPGFTKTDIFRDQSNSGGKGQKVMDMISTDCDLMVKMIMFGIEHKRPMMVHGLDAHAMSVFNRLLPVAGSELFSAIMKMADIDLFSEVFKD

SEQ ID NO: 13 - protein, 285 aa, Artificial Sequence
  Synthetic
MSDFTKAICGDWLNGKTVIVTGASGGMGAGIAATLIKKHNCRVVGVARNEAKMLKFIEELGPMYKDQFSYKLFDVSSREAWENFASELAEEGIVPSVLVNNAGILPKFKRFDRYSYEEIEKAMNINFYSCVYGVKTFLPVLLTQDDPGIINVDSSAALMTLAGTSMYSSSKAALKGFTEALRVEFRGKCYVGLVCPGFTKTDIFRDQSNAGGKGQKVMDMISTDCDLMVKMIMFGIEHKRPMMVHGLDAHAMSIFNRLLPVAGSELFSAIMKMADIDLFSEVFDD

SEQ ID NO: 14 - protein, 285 aa, Artificial Sequence
  Synthetic
MSDYTKALCGDWLNGKTVIVTGASGGMGAGIAATLIKKHNCRVVGVARNEAKMLKFIEELGPMYKDQFSYKLFDVSSREAWENFASELEEEGIVPSVLVNNAGILPKFKRFDRYSYEEIEKAMNINFYSCVYGVKTFLPVLLTQDDPGIINVDSSAALMTLAGTSMYSSSKAALKGFTEALRVEFKGKCYVGLVCPGFTKTDIFRDQSNAGGKGQKVMDMISTDCDLMVKMIMFGIEHKRPMMVHGLDAHAMSIFNRLLPVAGSELFSAIMKMADIDLFSEVFDN

SEQ ID NO: 15 - protein, 278 aa, Artificial Sequence
  Synthetic
MYCWLDSKTVVVTGASGGMGAGIAATLIKKHGCKVIGVARSESKMLKFIEELGPTYAEQFSYKLFDVSVRENWENFYNELVEEGVQVDVLINNAGILPKFKRFDRYSYEEIERAMNINFYSCVYSVKTFLPMLLKSSTPGIVNIDSSAALMSLAGTSMYSASKAALKGFTEALREEFRGKCYVGLVCPGFTKTDIFRSQDEGSGKGEKVINMISTNCDTMVKMIMFGIEHKQALQIHGMDAHAMSVFGKLLPVNGSRLFSAIMKAADIDLFAEVFKNE

SEQ ID NO: 16 - protein, 283 aa, Artificial Sequence
  Synthetic
MYCWLDGKTVVVTGASGGMGAGIAATLIKKHGCTVIGVARSEPKMLKFIEELGPTYAQQFSYKLFDVSVKENWENFYNELVEEGVQVDVLVNNAGILPKFKRFDRYSDEEIERAININFYSCVYSVKTFLPMLLQSTDPGIVNIDSSAALMSLAGTSMYSASKAALKGFTEALREEFRGKCYVGLVCPGFTKTDIFRGQSNAGGKGEKVINMISTDCDLMVKMIMFGIEHKQALQIHGVDAHAMSVFGKLLPVNGSRLFSAVMKAADIDLFKEVFKDDAELAE

SEQ ID NO: 17 - protein, 278 aa, Artificial Sequence
  Synthetic
MSNCWLNGKTCVVTGASGGMGAGIAATLIKKHGCKVIGVARSEPKMIKFIEELGPTYAEQFSYKLFDVSKKENWDNFVEELQADGVKVDILVNNAGILPKFKRFDRYDMDEIERAININFYSCVYSIKAMLPMLLESPEGGIVNIDSSAALMSLAGTTMYSASKAALKGFTEALREEFRGKLFVGLVCPGFTKTDIFRDQKNEGGKGQKIMDMISTDCDLMVKMIMFGLEHKQQLQIHGMDAHAMSVFGKLLPVNGSRLFSAIMKAADIDLFKDVFND

SEQ ID NO: 18 - protein, 278 aa, Artificial Sequence
  Synthetic
MSNCWLSGKTCVVTGASGGMGAGIAATLIKKHGCKVIGVARSEPKMKKFIEELGPTYAEQFSYKLFDVSKNENWVNFAQELKDEGVKIDVLVNNAGILPKFKRFDRYEMDEIEKAININFYSCVYSIKALLPMLLESNDPGIVNIDSSAALMSLAGTSMYSASKAALKGFTEALREEFRGKIYVGLVCPGFTKTDIFRDQKNDGGKGQKVMDMISTDCDLMVKMIMFGIEHKQALQIHGMDAHAMSVFGKLLPVNGSRLFSAIMKAADIDLFNDVFRN

SEQ ID NO: 19 - protein, 278 aa, Artificial Sequence
  Synthetic
MSNCWLSGKTCVVTGASGGMGAGIAATLIKKHGCKVIGIARSEPKMKKFIEELGPTYAEQFSYKLFDVSKNENWVNFAQELKDEGVKIDVLVNNAGILPKFKRFDRYEMDEIEKAININFYSCVYSIKALLPMLLESNDPGIINIDSSAALMSLAGTSMYSASKAALKGFTEALREEFRGKVYVGLVCPGFTKTDIFRDQKNDGGKGQKIMDMISTDCDLMVKMIMFGIEHKQALQIHGMDAHAMSVFGKLLPVNGSRLFSAIMKAADIDLFNDVFRN

SEQ ID NO: 20 - protein, 277 aa, Artificial Sequence
  Synthetic
MSNWLDGKTCIVTGASGGMGAGIAATLIKKHGCRVIGVARSETKMLKFIEELGPTYAKQFSYKLFDVSKNENWVNFVKELEEEDINVDVLVNNAGILPKFKRFDRYDMDEIEKAININFYSCVYSIKALLPMLMKSSDPGIINIDSSAALMSLAGTSMYSASKAALKGFTESLREEFRGKIYVGLVCPGFTKTDIFRDQKNDGGKGQKVMDMISTNCDIMVKLIMFGIENKQALQVHGMDAHAMNIFGKLFPVNGSRLFSAIMKAADIDLFSEVFKD

SEQ ID NO: 21 - protein, 277 aa, Artificial Sequence
  Synthetic
MSNWLDGKTCIVTGASGGMGAGIAATLIKKHGCRVIGVARSETKMLKFIEELGPTYAEQFSYKLFDVSKNENWVNFVKELEEENINVDVLVNNAGILPKFKRFDRYEMDEIEKAININFYSCVYSTKALLPMLMKSSDPGIINIDSSAALMSLAGTSMYSASKAALKGFTESLREEFRGKIYVGLVCPGFTKTDIFRDQKNDGGKGQKVMDMISTNCDTMVKLIMFGIEHKQALQVHGMDAHAMNVFGKLLPVNGSRLFSAIMKAADIDLFSEVFKD

SEQ ID NO: 22 - protein, 277 aa, Artificial Sequence
  Synthetic
MSNWLDGKTCIVTGASGGMGAGIAATLIKKHGCRVIGIARSEPKMLKFIEELGPTYAEQFSYKLFDVSKNENWTKLVEELEEEDIQVDVLINNAGILPKFKRFDRYDMDEIENAININFYSCVYSIKALLPMLLKSSDPGIVNIDSSAALMSLAGTSMYSASKAALKGFTESLREEFRGKIYVGLVCPGFTKTDIFRGQKNDGGKGQKVIDMISTDCDLMVKLIMFGIEHKQALQIHGVDAHAMNIFGKLLPVNGSRLFSAVMKAADIDLFSEVFKD

SEQ ID NO: 23 - protein, 277 aa, Artificial Sequence
  Synthetic
MSNWLDGKTCIVTGASGGMGAGIAATLIKKHGCRVIGIARSEPKMLKFIEELGPTYAQQFSYKLFDVSKNENWINLVSELEENNIQVDVLVNNAGILPKFKRFDRYDMSEIENAININFYSCVYSIKALLPMLMKSSDPGIINIDSSAALMSLAGTSMYSASKAALKGFTESLREEFRGKVYVGLVCPGFTKTDIFRDQKNAGGKGQKVINMISTDCDLMVKMIMFGIEHKQALQVHGVDAHAMNIFGKLLPVNGSRLFSAVMKAADIDLFSEVFKD

SEQ ID NO: 24 - protein, 277 aa, Artificial Sequence
  Synthetic
MSNWLDGKTCIVTGASGGMGAGIAATLIKKHGCRVIGIARSEPKMLKFIEELGPTYAEQFSYKLFDVSKNENWIQLVSELEEENIQVDVLVNNAGILPKFKRFDRYDMDEIEKAININFYSCVYSIKALLPMLMKSSDPGIINIDSSAALMSLAGTSMYSASKAALKGFTESLREEFRGKVYVGLVCPGFTKTDIFRDQKNDGGKGQKVINMISTDCDLMVKLIMFGIEHKQALQIHGVDAHAMNIFGKLLPVNGSRLFSAVMKAADIDLFSEVFKD

SEQ ID NO: 25 - protein, 277 aa, Artificial Sequence
  Synthetic
MSNWLDGKTCIVTGASGGMGAGIAATLIKKHGCRVIGIARSEPKMLKFIEELGPTYAEQFSYKLFDVSKNENWVDLAAELEKQNIQVDVLVNNAGILPKFKRFDRYDMDEIEKAININFYSCVYSIKALLPMLMKSSDPGIINIDSSAALMSLAGTSMYSASKAALKGFTESLREEFRGKVYVGLVCPGFTKTDIFRDQKNDGGKGQKVINMISTDCDLMVKLIMFGIEHKQALQIHGVDAHAMNIFGKLLPVNGSRLFSAVMKAADIDLFSEVFKD

SEQ ID NO: 26 - protein, 278 aa, Artificial Sequence
  Synthetic
MSNCWLNGKTCIVTGASGGMGAGIAATLIKKHGCKVIGVARSEPKMKKFIEELGPTYAEQFSYKLFDVSKNENWVEFAEELKEQGVKVDVLVNNAGILPKFKRFDRYDMQEIENAININFYSCIYSIKAFLPMLLESDDPGIINIDSSAALMSLAGTSIYSASKAALKGFTESLREEFRGKVYVGLVCPGFTKTDIFRDQKNEGGKGEKIMNMISTDCDLMVKMIMFGIAHKQALQIHGMDAHAMSVFGKLLPVSGSRLFSAIMKAADIDLFDDVFKD

SEQ ID NO: 27 - protein, 285 aa, Artificial Sequence
  Synthetic
MTDIKNCVGSDWLSGKTVIVTGASGGMGAGIAATLIKKHGCHVIGVARNEAKMLKFIDELGPTYAEQFSYKLFDVSDKEHWEDFAKELEEAGIRPSVLINNAGILPKFKRFDRYSYDEIERAMNINFYSCVYGVKTFLPVLLQQDDPAIINVDSSAALMTLAGTSMYSASKAALKSFTEALRVEFKGRMYVGLVCPGFTKTDIFRDQKNDGGKGQKVMDMISTDCDRMVKMIMFGIEHKRPRMVHGFDAHAMSVFNRLLPVSGSELFSMIMKAADIDLFDEVFKN

SEQ ID NO: 28 - protein, 279 aa, Artificial Sequence
  Synthetic
MANWLDGKTVVVTGASGGMGAGIAASLIKNHGCTVIGVARSEPKMLKFIEELGDTYAHKFSYKLFDVSVKENWENFAEELKANGTKIDILVNNAGILPKFKRFDRYSYDEIDKAMNINFYSCVYSTKTLLPIILESETPGIINIDSSAALMTLAGTSMYSASKAALKGFTEALRTEFKGKMYVGLVCPGFTKTDIFRNQGQTESNNKGAKVINMISTDCDLMVKMIMFGIEHKAPMQVHGFDAHAMSIFNRLMPVAGSELFSAIMKAAKVDLFDEVFRD

SEQ ID NO: 29 - protein, 278 aa, Artificial Sequence
  Synthetic
MDKNWLNFKTVIVTGASSGMGKGIAEKLIKVHGCNVIGIARSEKKMKTFVEELGEYADRFSYQLFDVSSLENWVDFRQYLEDNHIKPDILINNAGILPKFDKFQHYTIEEIESAMNINFYSAVYSMHTLLPLLLKSPSAAIINVDSSAALMSLAGTSVYSASKSALKALTESMREELRGKCYVGIVCPGFTKTDIFRNQGSSDEKAQKMLNMVSTSCDKMVKLIMNGIGKQHELMVFGKDAAFMNYFGRMMPVLGGRLFSAVMKMSKLPLFDGVFKED

SEQ ID NO: 30 - protein, 278 aa, Artificial Sequence
  Synthetic
MSNCWLDGKTCIVTGASGGMGAGIAATLIKKHGCRVIGVARSEPKMLKFIEELGPVYAEQFSYKLFDVSKNENWIEFAEELKENDIKVDVLVNNAGILPKFKRFDRYDMDEIQKAIDINFYSCVYSIKALLPMLMESDTPGIINIDSSAALMSLAGTSMYSASKAALKSFTESLREEFRGKIYVGLVCPGFTKTDIFRDQKNDGGKGQKVIDMISTDCDLMVKMIMFGIEHKQALQIHGIDAHAMNLFGKLLPVNGSRLFSAVMKAADIDLFSEVFKD

SEQ ID NO: 31 - protein, 278 aa, Artificial Sequence
  Synthetic
MECWLNNKTVVVTGASGGMGAGIAATLIKKHNCTVIGVARSEPKMLKFIEELGADYASKFSYRLFDVSVKENWESFAQELKDNGVKVDILVNNAGILPKFKRFDRYSYDEIEKAMNINFYSCIYSTKTLLPMLLESSSPAVINIDSSAALMTLAGTSMYSSSKAALRAFTEALRVEFAGKMYVGLVCPGFTKTDIFRNQGAESNSNGQKVMNMISTDCDIMVKRIMRGIENKYPMQVRGFDAHAMSIANRVAPVYGSKLFSSVMRMANVDIFKEVFSD

SEQ ID NO: 32 - protein, 277 aa, Artificial Sequence
  Synthetic
MNTNWMNNKTVIITGASGGMGKGVAERLIKEHGCTVIGIARSEEKMKKVVEELGNYADKFSYQLFDVSVEQNWLDFVDYLKENNIHPDVLINNAGILPKFDRFQNYSIDYIKKAMDINFYSAVYSIHALLPLLLESSAPAIINVDSSAALMTLAGTSVYSASKAALKSLSEALREELRGKCYVGIVCPGFTKTDIFRDQSATDDKGTKMLNAVSTPCDKMVNMIMRDIKFKRPLGVHGFDAAFMNYFGRIMPVQGGRLFSAVMKVSKLPLFDPVFKD

SEQ ID NO: 33 - protein, 277 aa, Artificial Sequence
  Synthetic
MDKNWLDNKTVIVTGASSGMGKGITEKLIKEHGCKVLGVARSEKKMEALVAELGEYASQFSYQLFDVSVRENWENYVAYLNENGIKPDVLINNAGILPKFDRFEHYSVEDIEKAMNINFYSAVYSMHALLPLLLESSSPAIINIDSSAALMSLAGTSVYSASKAALKALTESMREEMRGRCYIGIVCPGFTKTDIFRNQGSSDEKAQKMLNMVSTSCERMVKLIMNGIGHQRSLMVFGPDAGFMNYFGRLMPVTGGRLFSAVMKASKLPLFDGVFKD

SEQ ID NO: 34 - protein, 276 aa, Artificial Sequence
  Synthetic
MKNNWLNNKTVIVTGASSGIGRGITLKLIREYNCRVLGIARSKEKMKSLTNELGSDSENFSYLLFDVSKRENWKSFAEYIREKGIKPDILINNAGILPEFKKAESCSCEETERTMNINFYGAVYSMKELLPIILDSPSPAVVNIDSSAALMPLAGTSVYSASKAALKAYTEAVREELRGRCYVGVICPGFTQTDIFRSQNLTEEREQKIIGAVSTSLDYAVKRILKSIAKKRELTVIGADAKFMSIFGRLMPVKCGRAVSRVLKKSGFKLFDGVFK

SEQ ID NO: 35 - protein, 284 aa, Artificial Sequence
  Synthetic
MSDCKCCNGDWLSGKTVIVTGASGGMGAGIAATLIKKHGCQVVGVARSESKMLAFIEELGPTYAEQFSYKLFDVSVKENWENFAKELEEEGIVPSVLINNAGILPKFKRFDRYSYDEIERAMNINFYSCVYGVKTFLPVLLQQENPAIINIDSSAALMTLAGTSMYSASKAALKGFTEALRVEFKGKMYVGLVCPGFTKTDIFRDQKNDGGKGQKVMDMISTDCDLMVKMIMFGIEHKRPMMVHGLDAHAMSIFNRMLPVKGSELFSLVMKVADIDLFNDVFKD

SEQ ID NO: 36 - protein, 279 aa, Artificial Sequence
  Synthetic
MSECWLHGKTVVVTGASGGMGAGIAATLIKKHGCTVIGVARSESKMLKFIDELGEEYAKQFSYKLFDVSVRENWESFYQELKDNGTKVDVLINNAGILPKFKRFDKYSYEEIDMAMNINFYSSVYSVKTMLPILLESSTPAVINIDSSAALMTLAGTSMYSASKAALKSFTEALRLEFRGRMYVGLVCPGFTKTDIFRGQTGVNMDSGAKAMDMISTDCDKMVKMIMFCIEHKMPMQVHGFDAHAMSVANRIAPVYGSKLFSAVMRMANVDIFKEVFSD

SEQ ID NO: 37 - protein, 278 aa, Artificial Sequence
  Synthetic
MSNCWLNGKTCIVTGASGGMGAGIAATLIKKHGCKVIGVARSEPKMKKFIEELGPTYAEQFSYKLFDVSKNENWVEFAEELKEQGVKVDVLVNNAGILPKFKRFDRYDMQEIENAININFYSCIYSIKAFLPMLLESDDPGIINIDSSAALMSLAGTSIYSASKAALKGFTESLREEFRGKVYVGLVCPGFTKTDIFRDQENEGGKGEKIMNMISTDCDLMVKMIMFGIAHKQALQIHGMDAHAMSVFGKLLPVSGSRLFSAIMKAADIDLFDDVFKD

SEQ ID NO: 38 - protein, 278 aa, Artificial Sequence
  Synthetic
MSDCWLNGKTCVVTGASGGMGAGIAATLIKKHGCKVIGVARSEPKMLKFIEELGPAYAEQFSYKLFDVSNNDNWVEFKKELEEQGVQVDILVNNAGILPKFKRFDRYDMDEIERAININFYSCVYSTKAFLPMLLQSDDPGIINVDSSAALMSLAGTSMYSASKAALKGFTESLREEFRGKVFVGLVCPGFTKTDIMRDQVAQGGKGAKIIDMISTDCDLMVKMIMFGIAHKQHLQIHGVDAHAMSVFGKLLPVNGSRLFSAVMKAADVDLFNEVFKD

SEQ ID NO: 39 - protein, 278 aa, Artificial Sequence
  Synthetic
MDQNWLNNKTVIVTGASSGMGKGITEKLIKEHGCTVLGVARSQQKMEALVAELGEYADKFSYQLFDVSDRANWDNYLAYLQENNIQPDVLINNAGILPKFDKFQHYSIEEIEKAMNINFYSAVYSMHALLPLLLKSSSPAIINIDSSAALMSLAGTSVYSASKAALKSLTESMREELRGKCYVGIVCPGFTKTDIFRNQGSSDEKAQKMLNMVSTSCDRMVNLIMNGISKQHSLMVFGMDAAFMNYFGRLLPVQGGRLFSAVMKMSKLPLFDGIFKED

SEQ ID NO: 40 - protein, 262 aa, Artificial Sequence
  Synthetic
MIYENWLTRATVVITGASGGLGKGIAMKLIERYDCTVIGIARNEEKMKTVVADLGDKADHFSYQLFDVSIEENWKNFAEYLKENDIHPDILINNAGILPKFDRFGNYTIEYIKKAMDINFYSAVYSMHYLMPILLKSSKAAIVNVSSSAALCSLAGTSVYTASKAALKGLTEAAREEYRGECYIGLVCPGFTKTDIFSSQGNGDGSDSFANKAVEMISSSCDSMVRKIVHGISHKKDIMVYGVDAKLMEDGNRLAKVGTSKI

SEQ ID NO: 41 - DNA, 849 bp, Artificial Sequence
  Synthetic
atgacacatgaaaatttaaagggcagggttgccgttgttacaggcggcggcggagtcctttgcggacagtttgcacaaactcttgcaaagcagggctgtaaggttgccgtgcttgatttgaacgaggcagctgcacaggcttgtgctgacgaaatcgttgcaaacggcggtgaggctattgcagtaggttgcaatgttcttgacagcgaatcaatgcaaaatgcaagaaaaatcatcaacgaaaaactcggcacttgcgatattcttctcaatggtgcaggtggcaataatccaaagggcacaaccacaaaggacactcttgagcaaatcgaccttgttcaaaaggacgagaatgtaaagacctttttcgaccttgatgcagacggaatttcttttgtattcaatctcaacttcctcggcactcttattccaacacaggtttttgcaagagatatggtggaaaaagagcacgcttgcattgttatgataacttcaatgaatgcgtttagaccgctcacccgtatccctgcatattcggctgccaaagctgcggtaaagaactttaccgaatggatggctgttcactttgcaccaatgggaatcagagtaaacgcaatcgctccgggatttttctcaaccaagcagaatgcaacacttctttggaatgaggacggcactccgaccgcccgtacaggcaaaatccttgccgcaactccaatgaatcgttttggcgagccggaggaacttgacggaacacttctgttcctttgcgatgaggcatacagcggattcatcacaggcgtgaacatccctgttgacggaggcttcaacgcatacagcggagtataa

SEQ ID NO: 42 - protein, 282 aa, Artificial Sequence
  Synthetic
MTHENLKGRVAVVTGGGGVLCGQFAQTLAKQGCKVAVLDLNEAAAQACADEIVANGGEAIAVGCNVLDSESMQNARKIINEKLGTCDILLNGAGGNNPKGTTTKDTLEQIDLVQKDENVKTFFDLDADGISFVFNLNFLGTLIPTQVFARDMVEKEHACIVMITSMNAFRPLTRIPAYSAAKAAVKNFTEWMAVHFAPMGIRVNAIAPGFFSTKQNATLLWNEDGTPTARTGKILAATPMNRFGEPEELDGTLLFLCDEAYSGFITGVNIPVDGGFNAYSGV

SEQ ID NO: 43 - DNA, 840 bp, Artificial Sequence
  Synthetic
atgagcacatgttggcttcaaggcaagactgttgttgttaccggcgcttcaggcggtatgggtgcaggcattgccgcaactcttattaaaaaacacggttgtactgttatcggtgtggcaagaaacgaaaagaaaatgcttaagttcgttgatgagcttggcgaaacttatgcaaagcagttttcttatgagctttttgatgtaagttcaaaagagaattgggaaaaatttgcagaggagcttcaggaaaagggcgttaaggttgatgttctcatcaacaacgcaggtattcttccaaagttcaagagatttgacagatattcttatgaagaaatcgaaagagctatgaacatcaacttctactcttgcgtatattcagttaagacaatgttgccaatgcttcttcagtcaagcacaccggctatcatcaatattgactcatctgctgctcttatgacacttgcaggcacatcaatgtactctgcatcaaaggctgcacttaagggcttcacagaagcacttcgtgttgaattccaaggcaagatgtttgttggtcttgtttgcccgggcttcacaaagacagacattttctccggtcagggcgatgctgatatgagcaacggcgcaaaggttatggatatgatttcaaccgactgcgacaagatggttaaaatgattatgttcggcattgagcacaagacacctatgcaggttcacggttttgatgcacacgcaatgagcgttttcaaccgccttatgcctgtttacggctcaaagctcttcagctcaattatgagaatgtcaaatgttgacattttcaaggaagtattttctgattaa

SEQ ID NO: 44 - protein, 279 aa, Artificial Sequence
  Synthetic
MSTCWLQGKTVVVTGASGGMGAGIAATLIKKHGCTVIGVARNEKKMLKFVDELGETYAKQFSYELFDVSSKENWEKFAEELQEKGVKVDVLINNAGILPKFKRFDRYSYEEIERAMNINFYSCVYSVKTMLPMLLQSSTPAIINIDSSAALMTLAGTSMYSASKAALKGFTEALRVEFQGKMFVGLVCPGFTKTDIFSGQGDADMSNGAKVMDMISTDCDKMVKMIMFGIEHKTPMQVHGFDAHAMSVFNRLMPVYGSKLFSSIMRMSNVDIFKEVFSD

SEQ ID NO: 45 - DNA, 768 bp, Artificial Sequence
  Synthetic
atggataaaaaattattaggaaaagtaatagttgtatccggtggaacaaaaggtgtgggacgtgccgcatccgaagaatttgctcgtcagggggcaaaagttgttattggtggtagagatgaagaatctgctttaaaatcaataagaattatgcgtacctacggtagtgatggtctgtttgttcatactgatttgttaaatattgatgattgtaagaatctttttgataaagcatacgaaaagtttggaagaattgatggctttttcaactatgcaggtgtaacgcctgtttctccgcttgatacttgtgacgaagacacatttgattgggttatggatgttaacttcaaatcttgttttttctgttgtcagcaagcaattaaatatatgcgtgaaagtggtggaggatcaattgttcttacaggctctgctcacgcatggggtgggcaaaaagatagagcggcttatgcgtgttcaaaaggcgtgttgttgactcttatggagcatattgcccataattatgctgttgagcaaataagatgtaattatttgactttaggctggacacctactgaaggtgaagttagtttaagaatatcacaaggtgagtccgaagctgaattgcgacaaagagcatccgatatccttcctatgggaagaatgctggaaagaactgattatttagaagggttagtttatttgatgtcagattcttcgtcgatgatgactggctcgacattcagaattacagcaggagaatatatttga

SEQ ID NO: 46 - protein, 255 aa, Artificial Sequence
  Synthetic
MDKKLLGKVIVVSGGTKGVGRAASEEFARQGAKVVIGGRDEESALKSIRIMRTYGSDGLFVHTDLLNIDDCKNLFDKAYEKFGRIDGFFNYAGVTPVSPLDTCDEDTFDWVMDVNFKSCFFCCQQAIKYMRESGGGSIVLTGSAHAWGGQKDRAAYACSKGVLLTLMEHIAHNYAVEQIRCNYLTLGWTPTEGEVSLRISQGESEAELRQRASDILPMGRMLERTDYLEGLVYLMSDSSSMMTGSTFRITAGEYI

SEQ ID NO: 47 - DNA, 669 bp, Artificial Sequence
  Synthetic
atgaaaaaagcattaataacaggcggtgcgaccggaatcggcaaggcaaccgcaattttgttgcaacaaaacggatacgatgtgtacatcacatacaaccaaacaaagccggactatgaagtgaacgcaataaagtgcaatcttgaaaatattgacgaaatcgaaagtgccgttgaatcaatcggcagagttgacctacttgtgaacaacgcaggtgtgtctatcataaaaatgataaacgacatcacagtcgaggactacgaaaaaatgaccgccgtgaacgaaagagcggtgtattttgcaagcaagttttctgcgttgaaaatgataagagaacaaagcggtgcgataatcaacatcagttcaatgtggggtcaggtcggtgcttcgtgcgaaaccctatattcaatgacaaaggcaggaatcatcgggctgacaaaggcacttgcaaaggaacttgcgccaagcaacataaccgtgaattgcattgcaccgggaataatcgacacgagaatgaacaatatgtttgacgccgaggaattgaaagaagaagtgcctctcggcaggctcggaactcccgaagaaattgcacaggctgtgctgtttcttgcagaaagtccgtacatcacgggtcagattttaggcgtcaacggcggagctataatataa

SEQ ID NO: 48 - protein, 222 aa, Artificial Sequence
  Synthetic
MKKALITGGATGIGKATAILLQQNGYDVYITYNQTKPDYEVNAIKCNLENIDEIESAVESIGRVDLLVNNAGVSIIKMINDITVEDYEKMTAVNERAVYFASKFSALKMIREQSGAIINISSMWGQVGASCETLYSMTKAGIIGLTKALAKELAPSNITVNCIAPGIIDTRMNNMFDAEELKEEVPLGRLGTPEEIAQAVLFLAESPYITGQILGVNGGAII

SEQ ID NO: 49 - DNA, 20 bp, Artificial Sequence
  Synthetic
gtgtgtagcccagcacataa

SEQ ID NO: 50 - DNA, 21 bp, Artificial Sequence
  Synthetic
gctacgcaagagcactctaat

SEQ ID NO: 51 - DNA, 21 bp, Artificial Sequence
  Synthetic
gagcacgcttgcattgttatg

SEQ ID NO: 52 - DNA, 21 bp, Artificial Sequence
  Synthetic
acagccatccattcggtaaag

SEQ ID NO: 53 - DNA, 20 bp, Artificial Sequence
  Synthetic
gggcttcacaaagacagaca

SEQ ID NO: 54 - DNA, 22 bp, Artificial Sequence
  Synthetic
gtgctcaatgccgaacataatc

SEQ ID NO: 55 - DNA, 22 bp, Artificial Sequence
  Synthetic
gcatccgatatccttcctatgg

SEQ ID NO: 56 - DNA, 20 bp, Artificial Sequence
  Synthetic
atgtcgagccagtcatcatc

SEQ ID NO: 57 - DNA, 22 bp, Artificial Sequence
  Synthetic
aaatcgaaagtgccgttgaatc

SEQ ID NO: 58 - DNA, 22 bp, Artificial Sequence
  Synthetic
cctcgactgtgatgtcgtttat

SEQ ID NO: 59 - DNA, 46 bp, Artificial Sequence
  Synthetic
gtttaactttaagaaggagatataccatgtattgttggttagacgg

SEQ ID NO: 60 - DNA, 37 bp, Artificial Sequence
  Synthetic
ttagcagccggatctcattactccgccagctcggcgt

SEQ ID NO: 61 - DNA, 46 bp, Artificial Sequence
  Synthetic
gtttaactttaagaaggagatataccatgagtgattttactaaagc

SEQ ID NO: 62 - DNA, 37 bp, Artificial Sequence
  Synthetic
ttagcagccggatctcattaatcatcaaacacttcgc

SEQ ID NO: 63 - DNA, 46 bp, Artificial Sequence
  Synthetic
gtttaactttaagaaggagatataccatgagtgattatactaaagc

SEQ ID NO: 64 - DNA, 37 bp, Artificial Sequence
  Synthetic
ttagcagccggatctcatcaatcatcgaatacttcgc

SEQ ID NO: 65 - DNA, 834 bp, Artificial Sequence
  Synthetic
atggatcagaattggatgaacaataccaccgtgatcgttaccggcgccagcggtggtatgggcaaaggcatcgccgaatctttaatcgtggaccacggctgcaccgtgattggcatcgcccgcagcgaggagaaaatgaagaaggtggtggaggagctgggcccgaatgccgagaagttcagctacaagctgttcgacgtgagtgtggagcagaactggatcgacttcgccaagtatctggaggacaacgacatccacccagacattttagtgaacaatgcgggcattttaccgaagttcgaccgcttcgaacactacagcatggcggatatcgaaaaggcgatgaacatcaacttctatagcgccgtgtacagcatccatactttactgccgatgattttaaagagcaaaacgccgggcatcatcaacatcgatagcagcgcctctttaatgtctttagccggtacgagtgtgtacagcgccagcaaagcggctttaaaatctttaagcgaatctttacgcgaggaactccgcggtaaatgctacgtgggcatcgtttgcccgggcttcaccaaaacggatatcttccgcagccaagatgcgagcgatgccaaaggccagaaaatgctgaacgcggtgagcacgagctgcgaccgcatggtgaaaatgatcatgcacgatatccgcacccgccgcccactgggtgtgcatggtttcgatgccgccttcatgaactacttcggtcgtttaatgccggtgctgggcggtcacatcttcagcagcgttatgaaaatcagcaaactgccgctgttcgacccggttttcaaagattaa

SEQ ID NO: 66 - DNA, 882 bp, Artificial Sequence
  Synthetic
accgtgaacgttgtgtacaccatcatctacggcggcaagctgttcatgagcaactgctggctgagtggtaaaacttgtgttgttaccggtgcgagcggtggtatgggtgccggtattgcggcgactttaatcaagaagcacggctgcaaagtgatcggcgttgcgcgcagcgaaccgaaaatgaaaaaatttatcgaagaactgggcccgacgtacgccgaacagttcagctacaagctgttcgacgtgagcaagaacgagaactgggtgaatttcgcgcaagaactgaaagacgagggtgtgaagatcgacgttctggtgaacaacgccggcattttaccgaaattcaaacgcttcgaccgctacgagatggacgaaatcgaaaaagcgattaatattaatttctacagctgtgtgtacagcatcaaagctttactgccgatgttattagaaagcaacgaccccggtattgtgaacatcgatagcagcgccgctttaatgagtctcgcgggtaccagcatgtacagcgcgagcaaagcggctttaaaaggctttaccgaagctttacgcgaagaattccgcggcaaaatctacgttggtttagtgtgcccgggcttcaccaagaccgacattttccgcgatcagaaaaacgatggcggcaagggccagaaagtgatggacatgatcagcaccgattgcgatttaatggtgaagatgatcatgttcggcatcgaacataaacaagctttacagatccatggcatggatgcccacgcgatgagcgtgttcggcaagctgctgccggtgaatggtagccgtctgttcagcgccatcatgaaagccgccgacatcgacctctttaacgacgtgttccgcaactaa

SEQ ID NO: 67 - DNA, 883 bp, Artificial Sequence
  Synthetic
gtttaactttaagaaggagatataccatgagtaactggctggacggtaaaacgtgcatcgttaccggtgccagcggtggtatgggtgccggtatcgcggcgacgctgattaaaaagcacggttgccgcgtgatcggcattgcccgcagcgaaccgaagatgctcaagttcatcgaggagctgggtccgacctacgcggagcagttcagctacaaactcttcgatgtgagcaagaacgaaaattgggtggatctggcggccgaactcgagaagcagaacatccaagttgacgtgctggttaacaacgcgggcatcctcccgaagttcaagcgtttcgaccgctacgacatggacgaaatcgagaaggcgatcaatattaacttctacagctgcgtgtacagcatcaaggcgctgctgccgatgctgatgaaaagcagcgatccgggcatcatcaacatcgatagtagcgccgcgctgatgagtctggcgggtaccagtatgtacagcgcgagcaaagcggcgctgaagggtttcacggaaagtctgcgcgaggagtttcgcggcaaagtttacgttggtctggtgtgcccgggctttaccaagacggatatcttccgcgaccagaagaacgatggtggcaagggtcagaaggtgatcaacatgatcagcaccgactgcgatctgatggtgaagctgatcatgttcggcatcgagcacaagcaagcgctgcaaatccacggcgtggatgcccacgccatgaacatcttcggcaaactgctgccagtgaacggcagccgtctgttcagtgccgttatgaaagccgcggacatcgatctgttcagtgaggtgttcaaggactgagatccggctgctaacaaagcccg

SEQ ID NO: 68 - DNA, 35 bp, Artificial Sequence
  Synthetic
cggctatcatcaatattgactcagctgctgctctt

SEQ ID NO: 69 - DNA, 35 bp, Artificial Sequence
  Synthetic
cggctatcatcaatattgacgcatctgctgctctt

SEQ ID NO: 70 - DNA, 35 bp, Artificial Sequence
  Synthetic
gtcaatattgatgatagccggtgtgcttgactgaa

SEQ ID NO: 71 - DNA, 45 bp, Artificial Sequence
  Synthetic
cacttgcaggcacatcaatggcctctgcatcaaaggctgcactta

SEQ ID NO: 72 - DNA, 45 bp, Artificial Sequence
  Synthetic
cacttgcaggcacatcaatgtactctgcagcaaaggctgcactta

SEQ ID NO: 73 - DNA, 45 bp, Artificial Sequence
  Synthetic
cacttgcaggcacatcaatgtacgctgcatcaaaggctgcactta

SEQ ID NO: 74 - DNA, 45 bp, Artificial Sequence
  Synthetic
cacttgcaggcacatcaatgtactctgcatcagcggctgcactta

SEQ ID NO: 75 - DNA, 45 bp, Artificial Sequence
  Synthetic
cacttgcaggcacatcaatgtactcttcatcaaaggctgcactta

SEQ ID NO: 76 - DNA, 42 bp, Artificial Sequence
  Synthetic
cattgatgtgcctgcaagtgtcataagagcagcagatgagtc

SEQ ID NO: 77 - protein, 1714 aa, Artificial Sequence
  Synthetic
MQRNKLPELISGMVTCDKEINDMKDKYDVAVYGLWYGNNYGSIITYYALTRVLESLNYTYAMIRNPLGREIDIDALNRSHPLKFARDRYEVTPLLPINRLSELNNNFSAFVLGSDQMWNYNLSRPYGQSYFFDFVADDKVKIAYATSFGKDKYIGPEDEKIRTDRNLHRFDGISVRDDFSQRICKDEFGISAELLSDPVFLCPVEKYNELIAEASDFKVEGDYIFAYILDPNEKIGASIQKIAEETQKKVIVVFNESGDKESFKERLKISSELVSYELDPTVNEWLYLYKNSQYVLTDSFHGTCFSIIFQKPFVVMKNVGRGGARFPFLLGELGLLDRMIEKPEDFVSKFNEAGFNVNIDYTSVNEVILEKRKESIAWLKNHLDKALYNSRTVNKVVDEKNCSGCGACQEVCPKDAINLKYNNEGFLVPEIDSEKCVKCGICLKKCTSENPVYKNEAKPKCYAMMASDEIREISSSGGMFTVAAKYVIEQGGYVAGAAYEQDYKVEHIIINNIGDLWRLRGSKYMQSYAAKVYPEIKKLLKDGKMVLFTGMPCQVAGLYSYLGQEYANLYTIDLLCHGITSSKVFEKYHNDVLGAKKLNRLEFKQKTPWGWHAGINAYFTDGTTYQKPLESDMYFIAYLKSISKNTTCGKCVSNKLPRQGDLTIGDFWGIPKYDEEMSDLKGTSVVLVNNKKAEEFFEKLKSGMKKVREEPLEVAIRGNHIIKGPYRLHKNREEFFEYFDRMDFTSLTKGCYYNQIYKYYKQELDKKLPENYHEYYYLAEAAARYSNGRKIVTWIQSRKFEEILKKYFGLEVAFSIAKSETKVDNEKVFPVSKIKDGSSDFYIVAFDPKNAADTYALLEQYGYNNLQDFICRYHKPIVINEFDLSKGRYSDAYGNTIEGYTGIIKKIVFRGCNNHIIIGDKVTGSSNMSFDLLAGTYIEIEKECRFNGENRFITKSYSGKSEVIIRRGCRLTNALYRILSAGQILINEECTFETNLELHANAGKKIIIGRDSMFSHDIDLWAGDGHTIFDVSTGKNINSALEKQPSHRNAIIIGEHVWVGKGAFIMHGTNIGNGSIVGAKSVVKGQFPNNCSIGGNPAKIVRRDCAWARDIVTEDIKKCGRDEYFMKTSADNNTADVHKKNENSANQHREIENFEYPDEKIERKKIQNWLVTGGSSGLGKALVLRLIELGYKVAATSRDITKLEQLPDEVIKIQLDVRSLESCREAVNKAEEQMGTVDVLVNNAGLSHISTFEETPNEIADSIIETNYWGVSNMAKAIIPHMRKNKNGTMINISSASGFRQRNYGSYYVASKFAVESLTKSLKFECQKFMRVTAIEFGGLNTGLNKRQTVIHSKLDEYKQLPPLFPYKKGYSNKLDRAVEAVIKIANKKEMPRDLILGWDAYQQFPKAISFFEDEVEKYKPISITTDENKKDSIKLEDIVKPRNPDLKIQNWLITGASGGVGKILALRLNELGYSVTVTSRDISKMKTFPKEIYVIESPLDSAEECAKVVKAAVHKMGSIDVLVNNATCNCWCSFEECKEDIMRNVFYTNYILPQYMIKAALPYMRQSHNGTVVNLVSIAAIQPRARVSTYSAAKAGLEGLTRTLKAECHRFARFMAVELVCMKTGIMVHNPVIDTQIPEYQGLGRYTPEINNIPNRKDIAVQQLINVVNQEELPQSLLIGTESYLIAKNEIERAKKEFEEYKDATLSICEKQK

SEQ ID NO: 78 - protein, 264 aa, Artificial Sequence
  Synthetic
MVNFSLEGKVALVTGASYGIGFALATAFAQAGAKIVFNDIKQELVDKGIAAYKAEGIEAKGYVCDVTNEEQVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTKNIASEYGEFNIQCNGIGPGYIATPQTAPLREIQPDGSRHPFDSFIIAKTPAARWGTPEDLAGPAVFLASDASDFVNGHVLYVDGGILAYIGKQPK

SEQ ID NO: 79 - protein, 251 aa, Artificial Sequence
  Synthetic
MSTSDRFAGKVAVITGGTTGIGRAIARRFVSDGGKIVIGARHDTLFEEITQELGADNCWCQVCDVTNRAQVDALVQAAYDKFNGFDVMFGNAGINLFKDFLNVTEEEHARIVHNNYFGCFNSTQAAARAFVAHGTKGAIVNTASINVRCACPNSTPYAASKGAIATMTQGVAVELAEYGIRANCFCPGSTDTPMVTEVPRTRFPTYTAPKLMIQRMAQPEEQANIACFLASDDASYITGETIFCVGGWGKK

SEQ ID NO: 80 - protein, 246 aa, Artificial Sequence
  Synthetic
MEQNKTALVTGASRGIGRAIALQLAEDGFDVAVIFAGNEAAAQETCSLIEQKGRKAMPLRCDVSDPQQCKDAVKAVLDSFGGIDVLVNNAGITRDALVLSMKEEDFEKVIDTNLNSAFYMIKNTYHQFMKRRSGRIINISSISGLMGNAGQANYAAAKAGLVGLTKSVAKELAGRGITCNAVAPGFIETDMTAVLSEKVKTAAESQIPMKKMGRPEDVAAAVAFLASDAAGYITGQVLSVDGGLNM

SEQ ID NO: 81 - protein, 485 aa, Artificial Sequence
  Synthetic
MTQHFKYHVVSYLMILIFIAFIKLYGGKMKNIAVILSGGMGSRFGGTLPKQFTKLAGKAVIEYTVEAFEKSLNIDEIIIVSHPSYVDLIWKFVKKNQWEKVTKVFNGGKERFDSTYSALQGLEGEDNNSNILLHDAVRPLINESIINNCIDALRNFEAVDVVIPSADTLVEVYDDGCISNIPNRAIMRRGQTPQAFKLGTLKQAYQRAINAQRFSFTCDCGVVRSMVPGVRVATVVGAESNMKVTHPIDLFIAEKLLQEANKISFNTGDNLDYIKDKNIIIFGGNSGIGLEIKKAAILLGANVEIASRSFNNVDIVDIECVKNYLAQMEKKLGCIDYIINTAGVLIKKPIDMLTNEEVHTLININFIGAVNIAMASKQYLKKSSGMLLNFTSSSYTRGRSYYALYSSSKAAIVNFTQAIAEEWSSENIKVNCINPERTATPMRTINFGIEPAELLLDPRDVALTSLKVLGADSTGLIIDVRKDGR

SEQ ID NO: 82 - protein, 264 aa, Artificial Sequence
  Synthetic
MVNFSLERKIALVTGASYGIGFAIATGFAQAGATIVFNDIKQELVDKGLAAYKELGINAHGYVCDVTDEKAVNAFIAQIEKEIGTIDILVNNAGIIKRIPMCEMSAAEFRQVIDVDLNAPFIVSKAVIPGMIKKGHGKIINICSMMSELGRETVSAYAAAKGGLKMLTRNIASEYGEYNIQCNGIGPGYIATPQTAPLREKQPDGTPHPFDSFIIAKTPAARWGTPEDLMGPAIFLASDASNFVNGHVLYVDGGILAYIGKQPK

SEQ ID NO: 83 - protein, 251 aa, Artificial Sequence
  Synthetic
MSKKIIFITGVTSGVGRETARRFIKEGWKVIGTGRRQSRLDELAAELGGDFLPLCFDVAKRDVVVEMFANLPEGFKDIDVLLNNAGSSIGQNPAQAGNMDDWDEMIATNINGLLYCTRCVLPGMIERGSGHIVNIGSVAGNRAFKCGNVYGATKAFVNHFSRMLRCDLLGTPVRVTNIKPGHLHTEFLAVRFKGDLKTSEAAYENLDPLTPENIAESVWWSVNLPAHMDVCDMELMPMCQSDGGWSFCHKS

SEQ ID NO: 84 - protein, 246 aa, Artificial Sequence
  Synthetic
LFDLADNVAIVTGSTKGIGYAIAKKLLKNGAKVIINSRKSEEKVKEVLDELKAVSEAVYYIQADVSVEEEAKNLVNEAAKQFGKIDILINNVGITKVMSATMVKTETLYDLYNANILSAVFMTKFTLKKMLMNKYGRIINVSSVAGTNGMAMQSAYATCKAGLIGYTKSVAVEWGAKNITCNAVVPGAIKTHDTVDEKMEQYAIEHTPLKRMGTPDDVASAVIFLVSKDASFITGQALKIDGGMWI

SEQ ID NO: 85 - protein, 457 aa, Artificial Sequence
  Synthetic
MKNIAVILSGGSGARFGGTLPKQFTKLAGRAVIEYTIDAFERTELIDEIIIVSQPNYTELTWDYVKKNQWNKVTKIFNGGKERFDSTYSALQGLEGEDDNCNILFHDAVRPLIDETIISNCIESLKIFEAVDVVIPSADTLVEVYDDGCISNIPNRALMRRGQTPQAFKLGTIKLAYQRAIAEKRFSFTCDCGVVRSMVPGVRVATVMGTEANMKVTQPIDLFIAEKLLQEANKISFSTGDDLSFIKGKNIVIFGGNSGIGLEIQKEAILLGANVEVASRSFNNVDIANIKNIEHFLNNVNEKLGSIDYIINTAGVLIKKPIDALTFNEVNSLIGINYVGAVNIAIAAKKYLKKSSGMLLNFTSSSYTRGRSYYALYSSSKAAIVNFTQAIAEEWTSDNIKVNCINPERTATPMRTSNFGVEPSDLLLDPKDVALTSLKVLGSNRTGLIVDIRKDGR

SEQ ID NO: 86 - protein, 264 aa, Artificial Sequence
  Synthetic
MRLGLEGKTVVITGGAGGIGKEAARGFLKEGAAVAVFARTKEKVDDFCREMHGQGYHNIYGEVLDVADKAGVRCFTERVCQKFGTVDVWINNAGIAIDKPFLEYTEDEWDTIMNTDLKAVWNCIRLVAPIMIKQERGVIINISSFAAKIPSAGGAIYGAAKSGVSSLTRTLAAELAPYHIRVMGVVPGMIDTEISKANIKENGEQLVQNVSLGRLGTAEDLAGPIVFLASEQAEYMSGFDLEVTGGKFAVQNARWAWKIKERLI

SEQ ID NO: 87 - protein, 251 aa, Artificial Sequence
  Synthetic
MRTIIITGASGGLAQEMVKLLPEDRLILLGRNQEKLEDLYAGHPQAECIGIDITDSSAVQDLVEELTQRYGQIDILVNNAGYGIFEAFDRISDQQVREMFEVNTFALMNLSRLMGAHMKAAGKGHIVNIVSMAGLVATAKSSLYSATKFAAIGFSNALRLELMPFDVHVTTVNPGPIRTTFFDQADPDGSYVKAVDRYILEPDFVAKKIVKNFGKAKRELNLPWLLNLTHKLYTLFPRISDKLACKVFNFK

SEQ ID NO: 88 - protein, 246 aa, Artificial Sequence
  Synthetic
MDIKEKVALITGGGTGVGKGVALRLAQEGTNICINYAHSEKEAFEAKSEVEALGVKCGVYKADVSDDDQCKAMIADVIKDFGQLDILVNNAGRTHFVDHKDLDGMKSEYFDDIFALNVKGTFFMCRAAADALKKSHGVIINITSIAGVTGLGSSIAYAASKAAEISITKSLARVLAPEVRVIGVAPGIVLTRWVEGRTGHIDKLAGETPLQKVAVPEDIAQTVYALIAHADFVTGQNIIVDGGAFI

SEQ ID NO: 89 - protein, 457 aa, Artificial Sequence
  Synthetic
MKNIAVILSGGTGSRFGGTLPKQFTKLAGKAVIEYTIGAFEKSNNIDEIIIVSQSEHMHLTWDIIKKNKWKKVVKVFVGGKERFDSTYSALVGLEGYSHECNILIHDAVRPLINEHIINDCIYALKEFDAVDVVIPSSDTLVEVFDDECISNIPNRAFMRRGQTPQAFKLGTIKKAYQKAIKEQRFSFTCDCGVVRSMIPGIRVATVKGNEANIKITHPIDLFIAEKLLQEANKISYNPEDDLSFLKNKNLVVFGGTSGIGLEIKNSAILLGANVDVASRSYNNVDITDIHSINKFLAVVKKERGTIDYVINTAGLLIKKPIDSLSQSEINNLIGVNYIGAVNVAIASKQYLTESSGMLVNFTSSSYTRGRSLYALYSSSKAAIVNFTQALAEEWTTENIRVNCINPERTATPMRTANFGLEPTELLLNAKDVALTTIKILGTRNTGLIVDIRKDGR

SEQ ID NO: 90 - protein, 264 aa, Artificial Sequence
  Synthetic
MVNFSLEGKVALVTGASYGIGFALATAYAQAGAKIVFNDIKQELVDKGLAAYKAEGIDAKGYVCDVTNEEQVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREPQADGSRHPFDSFICAKTPAGRWLDPEELTGPAVFLASEASNAVNGHILYVDGGILAYIGKQPK

SEQ ID NO: 91 - protein, 251 aa, Artificial Sequence
  Synthetic
MAGFDFTGKTVWVTGAGKGIGYATALAFVETGARVTGFDLAFPQDDYPFATETLDVADAAQVGDVCGRLLGTLERLDVLVNAAGILRMGATDELSQEDWQQTFAVNVGGAFNLFQQTMGQFRRQQGGAIVTVASDAAHTPRIGMSAYGASKAALKSLALTVGLELAGSGVRCNLVSPGSTDTDMQRTLWKSDDAEQQRIRGFGEQFKLGIPLGKIARPQEIAATVLFLASDAASHITLQDIVVDGGSTLGA

SEQ ID NO: 92 - protein, 246 aa, Artificial Sequence
  Synthetic
MMKKILVTGASGGIGSQTAVAFAKCGCDVALHYSKNSEKAESLAEKLTNEYGINAFAVQADVSDYESVCKMFDKIDSRFGNLDVLVNNAGIAQQKLFTDITPDEWKKMTGVNLDGVFYCSQQALKRYMIKNHSGVILNISSMWGQVGASCEVHYSASKAGVIGLTKGLAKEVGLSGVRVNCICPGVIMTDMMKGFDEQTIQELKEETPLNMLGMPDDIAETAVFLCSNRAKFITGQIVGVNGGMII

SEQ ID NO: 93 - protein, 361 aa, Artificial Sequence
  Synthetic
MRRGEVTKGSAWALVTGAGSGIGRCFALRLARLGYRLVLVGNDLRKLECVRAELRALDAAEVRIISCDLARAGAAQELYDRLRAAGIAVDVLINNAGIFSFRDIIRTPAERIERVIMLHCLTATQLCRLVAREMAARNGFAAEPGPKDDDDPAMRTTTEGAAPAATGNEPATTGDAPETCSAPAATGSAPAAGTASAATNSAPAASAAAGSAPANTGSAAATCTSPAPPRRRFHILNMASYSLWMPFPGLTLYSASKAYLKCFSVAFAKEVREAGIRVTAVCPAGVATDLYGLTPRWQRIGLRMGVLISADCCARRGLWALWHGQRCTVPDWWNRLWIPLCKLLPMCLIRPIRRFTMKFQK

SEQ ID NO: 94 - protein, 264 aa, Artificial Sequence
  Synthetic
MKNQFSLEGKVALITGASYGIGFAIASSLANAGATIVFNDLKQEFVDKGLAAYKAEGIKAHGYVCDVTDEAGVNAMVAQIEKEVGVIDILVNNAGIIKRIPMVEMSAAEFRQVIDVDLNAPFIVSKAVIPSMIKKGAGKIINICSMMSELGRETVSAYAAAKGGLKMLTRNIASEYGEFNIQCNGIGPGYIATPQTAPLREKQADGSRHPFDSFIIAKTPAARWGNPEDLAGPAVFLASNASDFVNGHVLYVDGGILAYIGKQP

SEQ ID NO: 95 - protein, 251 aa, Artificial Sequence
  Synthetic
MRTILITGASGGLAQEMVKLLPEDQLILLGRNQEKLEDLYAGHPQAECIGLDITDSSAVQKLVEELTQRYGKIDVLINNAGYGIFEEFDQITDEQIHAMFEVNTFALMNLSRMIGAHMKEAGKGHIVNIVSMAGLVATAKSSLYSATKFAAIGFSNALRLELMPFGVHVTTVNPGPIRTSFFDQADPDGSYVKAVDRYILEPDFVAEKIVKNFGKPKRELNLPWLLNLTHKLYTLFPRISDKLATNMFNYK

SEQ ID NO: 96 - protein, 246 aa, Artificial Sequence
  Synthetic
MLTGKIAVVTGASRGIGKEIAKTLAAKGATVVVNYNGSAEKAEETVKEIEALGGKAEALQCNVSDYDKAAEMMAYVVKTYGRVDILVNNAGITRDNLLMKMSEEDFDAVLNTNLKGAFNCIKHISRQMLKQKSGHIVNISSVSGVMGNAGQVNYSASKAGVIGMTKAVAREMASRGITCNAVAPGFIKTDMTEVLSDTIKENISAQIPMRAFGETADVANLVAFLASDEAKYITGQVICVDGGMAM

SEQ ID NO: 97 - protein, 346 aa, Artificial Sequence
  Synthetic
MKRGEVTKGSAWALVTGAGSGIGRCFALRLARLGYRLVLVGNDLRKLECVRAELRALDAAEVRIISCDLARAEAAQELYDRLRAAGIAVDVLINNAGIFSFRDIIRTPAERIERVIMLHCLTATQLCRLVAREMAARNGFAAEPGQEGDNAMEPTPEGDAPAATGDAPETCSAPATGAASAATNSATGSAPAASAAAGSAPTTTGTAPATSPAPRRRFHILNMASYSLWMPFPGLTLYSASKAYLKCFSVAFAKEVREAGIRVTAVCPAGVATDLYGLTPRWQRIGLRMGVLISADCCARRGLWALWHGQRCTVPDWWNRLWIPLCKLLPMCLIRPIRRFTMKFQK

SEQ ID NO: 98 - protein, 264 aa, Artificial Sequence
  Synthetic
MVNFSLEGKIALVTGASYGIGFAIASGFAKAGATIVFNDIKQELVDKGLAAYQEAGIKAHGYVCDVTNEEQVNALVAQIEKEVGAIDILVNNAGIIKRIPMIEMSAAEFRQVIDVDLNAPFIVAKAVIPGMIKKGHGKIINICSMMSELGRETVSAYAAAKGGLKMLTRNIASEYGEYNIQCNGIGPGYIATPQTAPLRERQADGSRHPFDAFIVAKTPAARWGTPEDLVGPAVFLASEASDFVNGHVLYVDGGILAYIGKQPK

SEQ ID NO: 99 - protein, 251 aa, Artificial Sequence
  Synthetic
MRLKEKSIVVTGASSGMGKSIVERFVKEGALVVAVARRKERLDALKESLAQEKGQVLVFQGDVSKKEDNEKMIELAVQHFGKLDVLVNNAGIMDDMSGIGDATDEKYEQVMKVNVYGPMCAMRKAVSVFKEQGHGNIINVASVGGMRTAAGAIYCASKAALLAMTRNTAFMYIPDHIRCNAIAPGGIQTEIANSMGMPNPNGYARVQKVLAAAPQPGAPEDIAAAALFLASDESQYINGDTLVVDGGWIAG

SEQ ID NO: 100 - protein, 246 aa, Artificial Sequence
  Synthetic
MLNGKCAVVTGASRGIGKAIALKLASLGANIVINYRSSEKEALEVENEIKEMGVEAISIKADISKLDEVDNLIKTSKEKFGTIDIIVNNAGITKDNLILRMKEEDFDNVIDVNLKGVFNCLKSITPVMVRQKKGKIINISSVVGISGNAGQVNYAASKAGIIGMTKSLAKEIGTRGINVNAVAPGFIDTEMTESLGEKIKEEAKKNIPLKRFGTVQDVAEVVAFLASDESDYITGQVIHVDGGMLM

SEQ ID NO: 101 - protein, 346 aa, Artificial Sequence
  Synthetic
LQDGKPTASAAEWILFREKLLLRAMNEVSNEQRFADMEHGKDICLLQVTEPVLQQGKRCERNIFSVPFCLTCETGDVYFEIDMVTYCKEDDTVKALITGASSGLGRDMARVLAEKGWDLVLTARRLDRLEMLAAELSGVRVRVIGADLSKPEECLRLYRETAGEEIDLLINNAGFGNFGRFDETDLERDLDVISTNITAVHILTKLFVRDFVKRDGGRILNVASSAGFMAGPMLSGYYASKNYVVRLTEAIHEELRRQKSRVTVSLLCPGPVHTEFNQVAGVRFALRGLSSGYVARYAVERALRGKLIIQPGVLMRLARFGSRFLPEKAMLRISYHIQKSKDGAKS

SEQ ID NO: 102 - protein, 264 aa, Artificial Sequence
  Synthetic
MVNFSLEGKVALVTGASYGIGFALATAFAQQGAKIVFNDIKQELVDKGLAAYKAEGIEAKGYVCDVTNEEQVNAMVAQIEKEVGVIDILVNNAGIIKRIPMTEMTAAEFRQVIDIDLNGPFIVSKAVIPSMIKKGHGKIINICSMMSELGRETVSAYAAAKGGLKMLTRNIASEYGEYNIQCNGIGPGYIATPQTAPLRERQADGSRHPFDSFIVSKTPAARWGTPEDLMGPAVFLASDASDFVNGHILYVDGGILAYIGKQPQ

SEQ ID NO: 103 - protein, 251 aa, Artificial Sequence
  Synthetic
MRTILITGASGGLAQEMVKLLPNDQLILLGRNKEKLAQLYGNHSNVEWIEIDITDDSALETLVADLYLRYGKIDVLINNAGYGIFEEFDKISDQDIHQMFEVNTFALMNLSRRLAARMKESRKGHIINIVSMAGLIATSKSSLYSATKFAAIGFSNALRLELMPYDVYVTTVNPGPIRTAFFDQADPDGTYLNSVDRFLLEPDAVAKKIVKTIGKNKRELNLPLSLNLAHKFYSLFPKLADKLAGETFNYK

SEQ ID NO: 104 - protein, 246 aa, Artificial Sequence
  Synthetic
MLEGKVAVVTGASRGIGREVALTLAGYGATVIVNYCGSKDKAEAVVEEITAAGGNAKAYQGDVSDFNVAKEMMTSVKKEFGSIDILVNNAGITKDNLIMKMSEEEFDKVIEVNLKGAFNCMKHVSRIMLKQRYGHIINMSSVSGVMGNAGQVNYCASKAGIIGMTKSLARELGSRGITVNAIAPGYIQTEMTEVLPDDVKESILATIPLKRMGQTKDIAETVAFLASDKAAYITGQTIGVDGGMGM

SEQ ID NO: 105 - protein, 341 aa, Artificial Sequence
  Synthetic
MYENKTVLITGATGLIGSHIVDRLMELDNVRVIALSRNEEKLEIGFSKYLNDPRFRIIVGNIQENLEIDEKVDYIFHAASPMESKVIKNKPLDVINPNILGTINCLELLRKQKEEKGISGRMILFSSVTVYGNVTNNDIVVSEENTNVTEKLENLSAPYSQSKRMAEVIALAYYRQLEIDVVICRFSTVYGYTRFIPDTAFFEFIKKGLAHEDIILNSAGLPRRDNIYIDDAVTAALLIGATGDSGECYNISSNGELGNYAAVDEIANMIADIVNQNSDEDDIRVIFQNVNDSKRRSGIRLNNNKLKKLGWSPKISIEEGIRRTLNDLEKSNYCGRKGNAI

SEQ ID NO: 106 - protein, 264 aa, Artificial Sequence
  Synthetic
MVNFSLEGKVALVTGASYGIGFALATAFAQAGAKIVFNDIKPELVEKGLAAYEAEGIKAHGYVCDVTNEDQVNALVAQIEKEVGVIDILVNNAGIIKRIPMHEMSAADFRQVIDIDLNGPFIVSKAVIPSMIKKGHGKIINICSMMSELGRETVSAYAAAKGGLKMLTKNIASEYGEYNIQCNGIGPGYIATPQTAPLREKQPDGSRHPFDSFIVAKTPAARWGTPEDLMGPAVFLASDASNFVNGHILYVDGGILAYIGKQPQ

SEQ ID NO: 107 - protein, 251 aa, Artificial Sequence
  Synthetic
MPTILITGASGGLAQEMVKFLPNDQLILIGRNKEKLAQLYGNHPHAELIEIDITDDSALETLLAALYLRYGEIDVLINNAGYGIFEEFDQISDQDIHQMFEVNTFALMNLSRRIGARMKEKRQGHIINIVSMAGLIATGKSSLYSATKFAAIGFSNALRLELMSYSVYVTTVNPGPIRTGFFDQADPDGTYLKSVERFLLEADAVAKKIVKIIGKNKRELNLPILLNLSHKFYTLFPKLADKLAGGIFNYK

SEQ ID NO: 108 - protein, 246 aa, Artificial Sequence
  Synthetic
MLEGKIALVTGASRGIGRQIALTLAAQGATVVVNYNGSAARAEEVVNEITAAGGKAEAIQCNVAEFDKCAELLSGIIKQYGRLDILVNNAGITRDNLLMKMSEEDFDAVIQTNLKGVFNCVKHVSRQMLKQKSGRIINISSVSGVLGNAGQANYCAAKAGVIGLTKSAARELASRGITVNAVAPGFIRTDMTEVLSDAVKAAATEQIPMKHFGETEDVANLVAFLASDAARYITGQVISVDGGMAM

SEQ ID NO: 109 - protein, 341 aa, Artificial Sequence
  Synthetic
MKNFKKHILYQEDIHNILNTIDTDELSGKTFLVTGATGMVGVMLIDVLMKIPLTKVIAVGRNKERAQVRLGEYYAKSNFSFIEQDVQVPFPEDLKVDYIIPLASNTHPLAYSQFPIETMLINIEGARNALDLAVSCNASVIYPSSVEVYGNSIDGCFFSENYNGRLNLENSRACYSESKRTCEALCQSYKSERNVKVKIARLCRIFGPTMLLSDTKASSQFILKAIANEDIVLKSEGIQFFSYTYVADAVIGLLTILLKGEIGVPYNVSSEKTNIHLKDFAALCAEENGKRIIFDLPSDTEKKGFSIAMTAILDNNKIKTIGFEPRYEMRDAIHRTIEILK

SEQ ID NO: 110 - protein, 264 aa, Artificial Sequence
  Synthetic
MVNFSLEGKVALVTGASYGIGFAIASAYAKAGAKIVFNDIKQELVDKGIAAYKELGIEAKGYVCDVTNEEAVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIIAKTPAARWGNPEDLAGPAVFLASDASNFVNGHVLYVDGGILAYIGKQPK

SEQ ID NO: 111 - protein, 251 aa, Artificial Sequence
  Synthetic
MYNYNDLIGKKVLVTGASGDIGLAICGKFLEQKCTVYALYKTNAGPLLSLKENHIAGELLHILPCDLSKQDEVIALCEHLTREAGRLDVLVNNTGIVKDSLFASMTFDDFYSVINTNLLSLFRLTKEALMLLRSAETPAVINVASVAAIVPSVGQANYSASKGAILSFTRTLAAELAPRGVRVNAVAPGMIESKMAKKVPRTVVREVTNSIPLKRLGRCDEVADVIVYLSSAASSYIIGQTIVVDGGMVMR

SEQ ID NO: 112 - protein, 246 aa, Artificial Sequence
  Synthetic
MLSGKVAIVTGASRGIGRETALTLAGYGATVIVNYCGSKDKAEAVVEEIIAAGGTAKAYQGDVSDFDVAKEMITSVKKEFGSIDILVNNAGITNDKLLLRMTKEDFNACLDINLVGTFNMTQQAVKRMMKQRSGRIINMASVSGLMGNVGQANYAASKAGVVGFTKSVAREVAPRGITCNAIAPGFIQTEMTDVLSEKVKTQMNAQIPLQTFGQVEDVAATAIFLAKSPYITGQVVNVDGGLVMHG

SEQ ID NO: 113 - protein, 341 aa, Artificial Sequence
  Synthetic
MKLNKKHPLYQEDLQNILSLEGLKNIQGKSFLITGATGMVGVMLIDALMALGNVKVIAVGRNREKAKNRLGEYFDNENFEFLSQDVCEPFSKNLNVDYIIPAASNTHPLAYSQYPIETIFINIKGAENALNLASACGATVIYTSTNEVYGNAVSDEDFTEDYNGRLNLSNARSCYNESKRTSEALCQSYIAERGVDVKIARLCRIFGPTMLETDSKASSQFIKKAINNEDIILKSEGNQYFSYTYVADAVMGLLQVLLHGEIGVAYNVSSEKTNIHLKDFAQLCADYNHKKVIFDLPSAEEYKGYSIAMKAILSNDRIKGIGFKPMYSMEDAIRRTIEILR

SEQ ID NO: 114 - protein, 264 aa, Artificial Sequence
  Synthetic
MVNFSLEGKVALVTGAAYGIGLAIAQAFAEAGAKIVFNCSRQETVERGLKAYKELGIDAKGYLCDVTDEAAVKAMVADIEATVGTIDILVNNAGIIKRIPMEEMAVEDFRRVVDVDLIAPYICAKAVIPGMIKKGHGKIINICSMMSELGRETVSAYAAAKGGLKMLTRNICSEYGEHNIQCNGIGPGYIATDQTAPLRERQPDGSRHPFDSFIISKTPAARWGTPEDLMGPAVFLASDASDFVNGHVLYVDGGILAYIGKQPK

SEQ ID NO: 115 - protein, 251 aa, Artificial Sequence
  Synthetic
MNYADRFTGKVAVVTGGAKGIGKAIAERFVAEGGKIVIGDICTERFPELIEELGSDNAVCMRCDVSVKEDVDALVEKAYEAFNGFDIIFNNAGINIFKDFLNCTIEDSDKIFNTNFHGVFFGSQAAAKAFIAHDTKGVIVNTSSINFRCVTPNTTCYAASKGAISMFTRGIAVELSKYGIRANCFAPGTTNTDMVGESARERFPHYTAKRLVIPRMAKPEEQAAVALFLASDDASYMSGETVFNVGGWGIF

SEQ ID NO: 116 - protein, 246 aa, Artificial Sequence
  Synthetic
MDFTNKTVLVTGSSRGIGKAIAFAFGRAGARVVLNASRSKDQLEKTKKELEEMGVSCMAILADVSDYNACKDMFLQIQDAFGPVDILVNNAGISHIGLFTDMTPEQWQHMLNVNLGSVLNCTHLTVPAMVHNKTGVILNISSMWGEAGASCEAVYSASKGGINAFTKAMAKELGPSGIRVNAIACGVIDTEMNACFSEEERAELADEIALMRFGRPEEVGRFALTLASESASFLTGQIITLDGGML

SEQ ID NO: 117 - protein, 339 aa, Artificial Sequence
  Synthetic
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTMELLPALKNAKNSRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLESKGGLYCEDLNIARLMTSEEANNFSGGLRPHAIDHNDADRLWKISKNITGLDFE

SEQ ID NO: 118 - protein, 264 aa, Artificial Sequence
  Synthetic
VNEVYTMITGATGGLGGAFVRLAVKNGENLILTGRHEEKLRLLKEKILAENTGADVRIFAVDLSDEGSREETIRQIAAEHLKIGRLINVAGADIQKAFTEYTQEKLCFQCRVNLEAAVALCRFALERRTEELEILNISSVSGLYPMPYFAIYSATKAALTAFSLALREEMKGKGVRVTVVLPGAMPTRADIREQIKGQGIWGRLAAKSPDFVAEKSLKAVSRNRGKIIPGFWNKAMAAGTKFIPQSWKLRFIARRWSKISKDAF

SEQ ID NO: 119 - protein, 251 aa, Artificial Sequence
  Synthetic
MRTILITGASGGLAQEMVKLLPNDQLILLGRNKEKLAQLYGNNPNVEWIEIDITDDKALEALVADLYLRYGKIDVLINNAGYGIFEDFNKISDQDIHQMFEVNTFALMNLSRRLGARMKENRKGHIINIVSMAGLIATSKSSLYSATKFAAIGFSNALRLELMPYGVYLTTVNPGPIRTAFFDQADPDGTYLKSVDRFLLEPDAVARKIVKTIGKNKRELNLPVLLNLAHKFYTLFPKLADKLAGGIFNYK

SEQ ID NO: 120 - protein, 245 aa, Artificial Sequence
  Synthetic
MGKLDGKVAIVTGATSGIGQGVVWCYCEEGAKVVFCGRRREKGEAFEKELRDAGHDATFVQADMTNEQDVDMLFSATIEAYGKLDILVNNAGMMTNFQVETMDIANDFDRVMALNLHSYVYATQLAVKAMTDGGAIVNVASIGGLGGCPGMSSYGASKAATLSFTRSMGAELAPKGIRVNAICPGTIFSEMMPRDGEFTQYTLAKIPMGRGGEPREIGTVAVFFASDDSSYVTGTQLIVDGGMTA

SEQ ID NO: 121 - protein, 336 aa, Artificial Sequence
  Synthetic
VHLLDLNIYKRSNKKEDIAIIHSLSELILITFNQRIPPLFYCFYIGIACYETKHSDILFIFAGNTRNMQPQVILITGASSGFGKITAQMLSERGHIVYGTSRKPSEDMNHVKMLVVDVTNFLSVCQAVERILSEQGRIDVLINNAGIGIGGALELATEEEVNIQMNTNFFGVVNMCKAVLPSMRKARKGKIINISSIGGVMGIPYQGFYSASKFAVEGYSEALALEVYPFHIKVCVVEPGDFNTGFTDNRNISEQTRLDADYGESFLKSLEIIEKEERNGCHPRKLGAAICKIVECTNPPFRTKVGPWIQVLFAKSKKWLPDAVMQYALRIFYAIK

SEQ ID NO: 122 - protein, 264 aa, Artificial Sequence
  Synthetic
MVNFSLKGKVALVTGASYGIGFAIATGFAQAGAEIVFNDIKQELVDKGIAAYKELGINAHGYVCDVTNEEAVNALVAKVEREVGIIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREKQADGSRHPFEAFIVAKTPAARWGTPEDLMGPAVFLASDASNFVNGHVLYVDGGILAYIGKQPK

SEQ ID NO: 123 - protein, 251 aa, Artificial Sequence
  Synthetic
MRTILITGASGGLAQEMVKLLPEDRLILLGRNQEKLEKLYASHLQAECIGIDITDSSAVQDLVEELYQRYGQIDVLVNNAGYGIFEAFDRISDQQVQEMFEVNTFALMQFSRLMGAHMKAAGKGHIVNIVSMAGLVATAKSSLYSATKFAAIGFSNALRLELMPFGVHVTTVNPGPIRTTFFDQADPDGSYVKAVDRYILEPDFVAKKIVKNFGKPKRELNLPWLLNLTHKLYTLFPRISDKIASKMFNFK

SEQ ID NO: 124 - protein, 245 aa, Artificial Sequence
  Synthetic
MDKKIALITGASRGIGKETACTLAREGIFVVINYNGSHQKALDVLESIKKNGGEGAVYQCNVADYSQTEEMIQNLIKEYGHIDILVNNAGITRDNLIMKMSEEDFDKVIEINLKGCFNTIRHLSRQMLRQRSGKIINVASVSGVLGNAGQANYAASKAGIIGLTKTMARELASRGICVNAVAPGFIKTEMTEVLPESIRENVTGQIPLKRFGETKDIAEIIAFLASDKADYITGQVIHVDGGMAM

SEQ ID NO: 125 - protein, 335 aa, Artificial Sequence
  Synthetic
LLRDLQISTHFTNKEIFRKSPYELRKKRIFLLLQFHALGTIVSVEVQRGTKVKSFRAPFLHFRKLRKVCGVMGKLEGKVAVITGASKGIGEGIAKVYAKYGAKCVLAARGPKVLELAEQLKSEGYEATGVQVDVSDYKSVERIVETAEKTYGKIDVLVCNAGVCVLEDFLEDDTFENRDLHLDINVKGAWNVAKAVIPSMIANGGGAIVVTSSVTGDMVADPGEVAYATSKAALVGFTKALAREFADKNIRVNAICPGYVRTPLVEGMAKQSDPENPERAIQAIADAVPLKRLADPEEVGELAAFLGCYESSYITGTQIVIDGGSTLPETTSMGQ

SEQ ID NO: 126 - protein, 264 aa, Artificial Sequence
  Synthetic
MDLGLKGKVSLITGSTKGIGKAIAIEMAREGADVIINGRKKETVDQVVNEIKKKFPNTNPQGAAYDISIAEEREELFKQIPKVDVLVNNMGIFKPMNYFDISEETWQHFIDVNFYSGNALAKFYLPKMLKQDFGRIIFIASEEAVMPSGEMPQYSLTKTMNLSLAKSLSKLTVGTHVTVNTIMPGSTLTEGVEQMLVDMYKDSDLPKDQWESDFMKNHRPLSQIQRLIRPAEVGRFTAFVASPYSSSFSGEALRLDGGLVPTLY

SEQ ID NO: 127 - protein, 251 aa, Artificial Sequence
  Synthetic
MRTIIITGASGGLAQEMVKLLPNDRLILVGRSKAKLEKLYGEKENLDLVELDITDCSALERFAERIDTQYGHVDVLVNNAGYGIFEEFDKIRSSDIKSMFEVNTFALMNLSRIFGARMKQAGQGHIVNIVSMAGLIASSKSSLYSATKFAAIGFSNALRLELLPFGVYVTTVNPGPIKTSFFDQADPDGSYVKAVDKYILEPDFVASKIVSSFGKKKREMNLPGILNLAHKLYTLFPKIADKMATNMFNYK

SEQ ID NO: 128 - protein, 245 aa, Artificial Sequence
  Synthetic
MSLNGKTALVTGASRGIGRAIALRLAEDGANVAVIYAGSADKAEAVVNEITALGVNAKAYRCNVADSAAVNETVKAVTNDLGKIDILVNNAGITRDGLMLRMKDEDFDAVLDTNLKGAFNMIRACYSGFIRKKSGRIINISSVSGIMGNAGQANYSASKAGVIGLTKSVARELASRGITCNAVAPGFIQTDMTENLGDNNPLLNSIPLGRMGKPEDIAAAVAFLASDSAAYITGEVLKVDGGLAI

SEQ ID NO: 129 - protein, 335 aa, Artificial Sequence
  Synthetic
VLLENSSAAYCSPNFAETLIQNIYRVGLSLPQAIEFGSSSEKVGIGRSDIRENSYFYIRCYQLVAGTANEYLLKANVMSIQPLFDLTGKVAIVTGGGNGIGRACCETLAEAGATVVVSNRTPETGEAVVQAIRDKGGKALAIACDVLDDRALEHLVERTVEEFGAIHILVNNAGGGRGGHENPFELSAEEFEAIFRLNVFSAWKLCKLVVPHMARVGYGSIVNITSMASINKSPNMSAYASSKAALNHMTANLAFDFGPMNVRINCVGPGATRTRALSTVLTPEIESRMLAHTPIHRLGEPSDIAGAVLYFAAPVSEWVSGQVLFVNGGGVQTLD

SEQ ID NO: 130 - protein, 264 aa, Artificial Sequence
  Synthetic
MTNKVAVVTGGSSGIGLCTAEALRDLGCTVYELSRREFSDNGIRHISVDVTDEAAVASSIGQIIAEHKNIHILVNCAGFGISGAVELTELSDAKRQFDVNFFGMVNVNKAVLPYMRLGGGGRIVNISSVAAVAHIPLQTYYSASKAAIESYTCALANEVKPFGITVTCAQPGDIRTGFTAARKKNIAGDDIYCGRISRSVAGMEKDEQNGMSPQAAGAYIAKLALKKNVKPIYTVGFGYKCLSALCKFLPCRLRNWIVGLLYAR

SEQ ID NO: 131 - protein, 251 aa, Artificial Sequence
  Synthetic
MRTILITGASGGLAQEMVKLLPEDRLILLGRNQEKLEKLYASHPQAECIGIDITDSSAVQDLVEELYQRYGQIDILVNNAGYGIFEAFDRISDQQVQEMFEVNTFALMQFSRLMGARMKEAGKGHIVNIVSMAGLVATAKSSLYSATKFAAIGFSNSLRLELMPFGIHVTTVNPGPIRTTFFDQADPDGSYVKAVDRYILEPDFVAKKIVKNFGKAKRELNLPWLLNLTHKLYTLFPRISDKLACKMFNFK

SEQ ID NO: 132 - protein, 245 aa, Artificial Sequence
  Synthetic
MEKKVAVVTGASRGIGAAIARELAAAGMYVVINYCGSEEKAQELKTEIEQNGGEASIYRCDVSDNVACKEFIGNVIAEYGHLDVLVNNAGITRDGLLMRMSEEDFDAVLDTNLKGAFHTIQAVSRQMLKQRSGRIVNISSVVGVSGNAGQANYAASKAGIIGLTKAVAKELGSRGITVNAVAPGFIDTDMTQSLPEKVVEATLAQIPLGKFGEPEQVAKAVAFLASEDASYITGQVLHVDGGMVM

SEQ ID NO: 133 - protein, 334 aa, Artificial Sequence
  Synthetic
MTSQINRQYQLAQRPSGLPGRDTFSFVETPLGEPAEGQILVKNEYLSLDPAMRGWMNDARSYIPPVGIGEVMRALGVGKVLVSKHPGFQAGDYVNGALGVQDYFVGEPKGFYKVDPSRAPLPRYLSALGMTGMTAYFALLDVGQPKSGETVVISGAAGAVGSVAGQIARLKGCRVVGIAGGAEKCRFLVEELGFDGAIDYKNEDLAAGLKRECPKGIDVFFDNVGGEILDTVLTRIAFKARIVLCGAISQYNNKEAVRGPANYLSLLVNRARMEGMVVMDYAQRFPEGLKEMATWLAEGKLQSREDIVEGLETFPETLLKLFSGENFGKLVLKV

SEQ ID NO: 134 - protein, 264 aa, Artificial Sequence
  Synthetic
MINQFSLEGKVALVTGAAYGIGLAIAEAFAAAGAKIVFNCSRQSTVDRGLEAYKALGIDAKGYLCDVTDEEAVKAMVADIEATVGTIDILVNNAGIIKRIPMEEMAVDDFRRVVDVDLVAPFIVAKAVIPGMIKKGHGKIINICSMMSELGRETVSAYAAAKGGLKMLTRNICSEFGGANIQCNGIGPGYIATEQTAPLREIQPDGSRHPFDQFIISKTPAGRWGTPDDLKGPAVFLASDASNFVNGHILYVDGGILAYIGKQP

SEQ ID NO: 135 - protein, 251 aa, Artificial Sequence
  Synthetic
MAETILVTGASAGFGQAICQRLVADGHRVIGAARRIEKLQALHEELGEAFYPLQMDVTDLTQVDHALASLPADWEQIDVLVNNAGLALGLAPAQKAEIADWLTMIQTNIIGLTYLTRQILPQMVERNDGYVINMGSTAGTVPYPGANVYGASKAFVKQFSLNLRADLAGKQIRVTNIEPGLCEGTEFSAVRFKGDEKRVEALYRDAHAIQPEDIANTVSWLIQQPKHVNINRIEMMPVSQSFGPQPVYRGD

SEQ ID NO: 136 - protein, 245 aa, Artificial Sequence
  Synthetic
MFELHDKVALITGAAGGLGDKIARTLHKQGATLALTDMRAEPMEKLKAELGDRVEVFTANLTNPEDVKNLVSQVEEKLGRIDILVNNAGLTRDNLFIRMSDEDWQLVLDVNLSAGFKLAKAAVRGMMKRRFGRIIGIASVVGVTGNAGQANYSASKAGMIAMNKCLAQEVGSRGITVNSIAPGFIRTPMTDVLPDDVKAALLAKIPEGKLGEAQDIANVVAFLASDEAQYITGQTININGGMAMI

SEQ ID NO: 137 - protein, 331 aa, Artificial Sequence
  Synthetic
MSVMVITGGTAGAGKTTALRFARAGYHVALIARDETGLQETQQACERFGVKTLAISADVADAGAVQRAASEVEASLGAIDVWINNAMTTVLAPFRQMSDDEFRRVTEVTYLGYVNGTRAALEVMTPRDRGVIIQAGSALAWRSIPLQSAYCGAKAAIRGFTDAVRTELMHEKSHIQLTMVQLPGMNTAQFGWARNKMEQAMQPVPPVYQPEVAAEAIYSVIQRPVNELWVGKSTIQSILGQVFFPRLLDRLMVKKAWEGQFTGQPKPAEHQDDLFTPVRGNHPGHGPFNDGARRKAVTISADLPGKVAAGVGVAVATMALRALFRRPGRRR

SEQ ID NO: 138 - protein, 264 aa, Artificial Sequence
  Synthetic
MVNFSLEGKIALVTGASYGIGFAIATGFAQAGATIVFNDIKQELVDKGLAAYKELGIEAHGYVCDVTNEEAVNAMVAQIEKEVGVIDILVNNAGIIKRIPMCEMSAAEFRQVIDVDLNAPFIVSKAVIPAMIKKGHGKIINICSMMSELGRETVSAYAAAKGGLKMLTRNIASEYGEFNIQCNGIGPGYIATPQTAPLREPQADGSRHPFDAFIIAKTPAARWGNPEDLMGPAVFLASDASNFVNGHVLYVDGGILAYIGKQPK

SEQ ID NO: 139 - protein, 251 aa, Artificial Sequence
  Synthetic
MAGFDFTGKTIWVTGAGKGIGYTTALAFVKAGAQVTGFDREFPQDNYPFATEVLNVADAGQVAEVCQRVLKACERLDVLVNAAGILRMGATDALSVEEWQQTFAVNVGGAFNLFQQTMAQFRRQQGGAIVTVASDAAHTPRIGMSAYGASKAALKSLALTVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 140 - protein, 245 aa, Artificial Sequence
  Synthetic
MALMSKAAIVTGAAQGIGKAIAARLVKDGMRVAIVDINQEAAVAAAEELAGQYGAETMAVQCDVSQEEQVNTAVQKVLERFGTVDVLVNNAGILSLKKPFVEYTKADWDKIFGINFMGDVFFCKAVIPTMKEKKAGRIINMASQSAETGGLAASPIYAASKAAVWCMTKSLAGEMGPYQVTVNAVAPGYIMTEMTRNAGYRDDMVPMKRLGTPEDVADVVGFLASEDSRYVTGMIVDINGGTVMR

SEQ ID NO: 141 - protein, 331 aa, Artificial Sequence
  Synthetic
MSVMVITGGTAGAGKATALRFARAGYHVALIARDETGLQETRQACERFGIKTLAISADVVDAGALQRAAAEVETTLGAIDVWINNAMTTVLAPFRQMSEEEFRRVTEVTYLGYVNGTRAALEVMIPRDRGVIIQAGSALAWRSIPLQSAYCGAKAAIRGFTDAVRTELMHEKSHIQLTMVQLPGMNTAQFGWARNKMDQAMQPVPPVYQPEVAAEAIYSVIQRPVNELWVGKSTIQSILGQVFFPRLLDRLMVKKAWEGQFTGQPKSSDQQDDLFTPVRGNHPGHGPFNDGARRKAVTISADLPGKVAAGVGVAVATMALRALFRRSGKRR

SEQ ID NO: 142 - protein, 264 aa, Artificial Sequence
  Synthetic
VDLGLSGKTVVITGASKGIGLAAAELFLEEGAKVAICARSEEQLMEAVKLLSSKGEVLGIVADVSKANEMYQFAEKVFQHFGRIDCWVNNVGASMERRGEEYSEEEVEWTVGVCFKSAVYGCQAAFRYMKEHGGSIINISSLAARCGTVGRSTLYGPLKAAVVQLATMFAGEYAAYGIRVNAVLPGFTMTPAVQRNIPKEELQKNAEGTLLHRVAIPEEIASAIVFLSSPRASYITATSLEVSGGRSVVLNPSYSYEQKAIREQ

SEQ ID NO: 143 - protein, 251 aa, Artificial Sequence
  Synthetic
MKVIKAALVTGGATGIGKACALSFLEGGYAVAIVGRRKEKIEETEKELADIFGNEKVLAIAADVSSREDVEKIFASIDEKYGRIDVVINNAGVAPSHPFLETSYEEYDKAIKINQYGTFMCMQKGAKMMVEKGISGVIINMGSIYGKVASGNIIGYNASKGAVEMMTKAAALELAPYNIRVVSIAPGVIDTPMLEIDKQRGTFEELYSKGMRKKPLPPLAIGKTALFLASEAADGINAVTIPVDDGFLGYK

SEQ ID NO: 144 - protein, 245 aa, Artificial Sequence
  Synthetic
MFELHDKVALITGAAGGLGDKIARTLHKQGATLALTDMRAEPMEKLKAELGDRVEVFTANLTNPEDVKNLVAQVEEKLGRIDILVNNAGLTRDNLFIRMSDEDWQLVLDVNLSAGFKLAKAAVRGMMKRRFGRIIGIASVVGVTGNAGQANYSASKAGMIAMNKCLAQEVGSRGITVNSIAPGFIRTPMTDVLPEDVKAALLAKIPEGKLGEAQDIANVVAFLASDEAQYITGQTININGGMAMI

SEQ ID NO: 145 - protein, 331 aa, Artificial Sequence
  Synthetic
MSVMVITGGTAGAGKATALRFARAGYHVALIARDETGLQEAQQACERFGIKTLAISADVADAGALQRAAAEVEATLGAIDVWINNAMTTVLAPFRQMSEEEFRRVTEVTYLGYVNGTRAALEVMAPRDRGVIIQAGSALAWRSIPLQSAYCGAKAAIRGFTDAVRTELMHEKSHIQLTMVQLPGMNTAQFGWARNKMDQAMQPVPPVYQPEVAAEAIYSVIQRPVNELWVGKSTIQSILGQVFFPRLLDRLMVKKAWEGQFTGQPKPAEHQDDLFTPVRGNHPGHGPFNDGARRKAVTISADLPGKVAAGVGVAVATMALRALFRRSGKRR

SEQ ID NO: 146 - protein, 264 aa, Artificial Sequence
  Synthetic
MKDSLRNKVVVITGASSGIGRSIALESAGRGATVILIARRKDQLDEIAAEAKELSGAEAYVFPTDMGKPEEIEQTFNAITKQVKHIDFLVNCAGFGKFEEFMDQKMQDVTNMFQVNVLGLMYFTRLVGRVMMEQKTGQIINFGSIAGKVPTTKSAAYSASKAAVIQFSNVLRLELKPFGVKVMTVNPGPVYTNFLNVADKTGNYVKNVQEFMLDPDDVAWQVVHFFGSDKRELNLPLSLAVAAKLYNLFPSIGDEISLKFASRK

SEQ ID NO: 147 - protein, 251 aa, Artificial Sequence
  Synthetic
MTKIALVTGASAGFGKAIVKKLVADGYQVIVSARRLEKLQSLQAELGSDKVYPLQMDVSEPKLIDQALASLPEDWQHIDLLVNNAGLALGLDKTYEADFTDWMTMINTNIVGLVYLTRQVLPSMVKRDSGMIINLGSTAGTIPYPGANVYGASKAFVKQFSLNLRADLAGTKIRVTNIEPGLCEGTEFSNVRFKGDDERAEKLYEGAHAIMPEDIANTVSWVASQPEHVNFNRIEMMPVSQTYGVQPVYRD

SEQ ID NO: 148 - protein, 245 aa, Artificial Sequence
  Synthetic
MRLENKTAIVTGAGRGLGKGIALKLAAEGAKVIVADMSMETASATAEEINASGGTAKAFAVNIAKQDEVKAMMDFTVESFGTLDVIVNNAGINRDAMLHKMTVEQWDQVIAVNLTGTFYCVQYAAQIMREKGSGAIINISSASWLGNIGQANYAASKAGVVGLTKTACRELARKGVTCNAICPGFIDTDMTRGVPEKVWDTMISKIPMGRAGSPADVANMVAFLASDEANYITGEVINVGGGMIL

SEQ ID NO: 149 - protein, 328 aa, Artificial Sequence
  Synthetic
MAVIVITGGTAGVGKATALHFAKAGYDVGIIARDEQSLRSTEEELRRFGINARAVQADVADSKAVTDAANEIEYRLGAIDVWVNNAMGGMLAPFRTMSPEEFRRVTEVTYLGYVNGTRAALELMTPRDRGTIIQVGSALAYRSIPLQSAYCGAKAAIRGFTDAVRTELMHENSRVQIAMVQMPGLNTPQFEWARNKFAWAMRPVPPVFQPEVAASAIFKVAQKPVRELWVGSSTVQSIVGQFLFPGFLDRLMVKKAWEGQMTDTLNADDRQDYLDQPVNDLHKIHGHFTDEAKERAISVTSGMPGKVLLGSLAVTGAIVARLLLSRRR

SEQ ID NO: 150 - protein, 264 aa, Artificial Sequence
  Synthetic
MVQYDLDGKVALVTGASHGIGFAMAKALGKAGARVAFCCRTEERRDAAVAQYRECGLEVAGYVCDVTDEEQVSSMVRAIENDLGGVDILVNNAAVIKRVPMHEMDAADFRKIIDTDLTSAFIVSKAVLPHMMEQRSGKIINLCSMMSEFGRETVSAYASAKGGIKMLTRNIASEYGQYNIQCNGIGPGYIATAQTAPLIERLPDGSRNPFDQFIMSKTPADRWGTPEDLMGPTLFLASSASDFVNGHILYVDGGIVAYLGRQPK

SEQ ID NO: 151 - protein, 251 aa, Artificial Sequence
  Synthetic
MAGFDFTGKTVWITGAGKGIGYTTALAFVDAGAQVTGFDREFALAEYPFATEVMDVANAQQVAQVCERLLANTGRLDILVNAAGILRMGPTDALSVEDWQQTFAVNVGGAFNLFQQTMAQFRRQRGGAIVTVASDAAHTPRIGMSAYGASKAALKSLALTVGLELAGSGVRCNVVSPGSTDTDMQRTLWVSDDAEQQRIRGFGEQFKLGIPLGKIARPQEIANTILFLASDLASHITLQDIVVDGGSTLGA

SEQ ID NO: 152 - protein, 245 aa, Artificial Sequence
  Synthetic
MKHTVLVTGSSRGIGRAIAERFARDGHRVAIHCRVRRAEADALKAALQQEHLSVMAVQGDVSKEAEVARMLEEIRAYFGPVDVLVNNAGIALPQQLLTDCTVTDWDRLFGVNVRGAFLCCRGVLPDMVRKKRGSIVNLSSMWGVTGGSCEAPYSASKAALIGLTKALAREVAPSGIRVNCVAPGFVPTGMNAHLGPEAVEGIREETPLLTLGTPEDVAAAVCFLACEDARFLTGQVLCCDGGRCM

SEQ ID NO: 153 - protein, 328 aa, Artificial Sequence
  Synthetic
MAVIVITGGTAGVGKATALKFAKAGYDVGLIARDEASLHSTQEELRRFGVNAHAVQADVADSQAVVDAANEIEYRLGAIDVWVNNAMGAVLAPFRTLTPDEFRRVTDVTYLGFVNGTRAALELMVPRDRGVIIQVGSALAYRSIPLQSAYCGAKAAIRGFTDAVRTELMHENSRVQLSMVQMPGLNTPQFEWARNKFAWAMRPVPPVFEPEVAASAIFKVAQKPVRELWVGSSTIQSIVGQFFFPGYLDRLMVKKAWEGQMTDDLNAADRRDYLDQPIDDLHKIHGRFTDEAKNRATSVTSGMPGKVALGALAVAGIMLTRLITRRKR

SEQ ID NO: 154 - protein, 264 aa, Artificial Sequence
  Synthetic
MIDFSLKGKVALITGASYGIGMAIATAYSEAGATIVFNDIKPELVDKGLAAYAEKGIKAHGYVCDVTNEEQVNAMVAQIEKEVGVIDILVNNAGIIKRIPMHEMSAAEFRQVIDIDLNGPFIVSKAVIPSMMKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASEASNFVNGHVLYVDGGILAYIGKQPK

SEQ ID NO: 155 - protein, 251 aa, Artificial Sequence
  Synthetic
MESNYSDLRGKTALITGCNRGIGKEILTKFALQGVNIVACIRTRTEDFSLFLDSLREHYNIYIEVLLIDLTNSESIAGAMREIFRQKISVDILVNNAGVAFGGFLSMTSMSKLREVFEINFFSQVLITQYVAKWMQKRKSGVIINMASIAGIDGMAGYTAYGSSKAALIYFTKTLSKELATSGVRVNAVAPGLINTEMAKQMEEKAAEKMLEQNGMRRLGNPTEVADLVLYLSSDSSSFINGQVIRVDGGV

SEQ ID NO: 156 - protein, 245 aa, Artificial Sequence
  Synthetic
MNKKTVLITGASRGIGRAIAKLFAENNYNVVINYNKSEDEAKELQNYLTNKGYSVRIFKADVSNINEVNSLVNYTIGQFEKIDVLINNAGISKTNLFTDISYEEWNEIMNVNLNGVFYTTKKALQYMLPEMSGKIINISSIWGMVGGSFEVHYSASKAAIIGMTKALAKELGPSNINVNCIAPGVIKTDMLNNISEDTLDMLKEETPLMKLGSPEDIAKCALFLASEGGDFLTGQVISPNGGFVI

SEQ ID NO: 157 - protein, 326 aa, Artificial Sequence
  Synthetic
VISKIDKEKIKTWFVTGASSGVGQELCRQLLARGYNVIAVARRVPDFKHKNALCLSCDVTNPDEVQNAITKGLEVFGKIDVLSNNAGISANITCEEENIDHLKQVMEVNYFGAFNTINAILPHFRENNNGTIISNTSKSGLAPRAYGTAYCSSKFAIEGLTGVVWHETKSFCRVMAFELGWFEGTEIGIKKKIISPEFECYKNLPIFYKPLIYDFRNDLSIAVKTIIDTVEKEKLPRHLILGKDALETVKYEIKALNLCYNYCKKIGLYCSIPLKKDSFLSTIFSIKNEYKNGTKRKIITILGIKLKIKAEIHMVVRERESNPSTR

SEQ ID NO: 158 - protein, 264 aa, Artificial Sequence
  Synthetic
MSIKYKRQYRKKEKENMLLEGKIAVVTGGTRGIGYATVKAFLEQGAKVALFGSREETVKIALEKLNEENADYPVIGLHPNLMDPQEVKSAFQTVVDEFGRIDILVNNAGISQRDKIFDYNIEDFEMIMNLNVNAVFICSKEAASLMKNQGGGVILNTSSMVSLYGQPAGAGYPTSKFAVNGMTKSLARELGKDHIRVNAVAPGVIKTDMVAALPDEVIQPIINTIPLRRVGEPEDVANAFVFLASDMASYITGVILSVDGATMS

SEQ ID NO: 159 - protein, 251 aa, Artificial Sequence
  Synthetic
MEENREKSIVNKVVVVTGGSRGIGAQIVKTLANENYKVILNYNNSKEQAEKIQQELLEQGKEIEIIKADVSKKEEAEKLIQFAINKFNKIDILINNAGISQEGLFTDVTEEEWQKIINTNLNSVFYCNQQALKYMIQEQQGCIINISSIWGETGASCEVAYSTTKAAINGMTKALAKEVGPSNIRVNAIAPGIIDTDMNKNLTIEEHKQIKEQIPLNRIGKAIDIAKCVKWLVEDEYTTGQIISINGGWYI

SEQ ID NO: 160 - protein, 245 aa, Artificial Sequence
  Synthetic
MKRFQNKVSLITGGNKGIGRAIALRLASEGSSIILFGRNEKDNQSVEKEISSTYSVPVKSYNVDMSSKKSVEEGIGQAMSHFRRLDVLINNAGICRLSTPFTEIKEEDWKETLSVNLYGVIYVTGLVIPYLEKEGGKIINIASLAGEVGGIATSADYVASKAALQGITKSLARELGVKHINVNAIAPGFVRTQMTEKMRIQLSSIPLRQVAEPEDIAAAAAFLASDDARLITGTTLDVNGGLYMN

SEQ ID NO: 161 - protein, 325 aa, Artificial Sequence
  Synthetic
VFVKLQSQQFFYCLKTDIFGWYFFVIWLGTKKDCAYTIKIEIKTNENYLKYIIEMQEEKKQMGKLDGKIAVVTGAAQGIGYGCAKVMAKHGATVILVDFSESVALAAEEIRNMGYKADHFRVDVSSLEDVQKMADGIIEKYGKIDILHNNAGVNRRVRFENLDVKTRDFIMGVNILGVWNMTKAVYPYMLKEKYGRIINTSSVTGTRVVDEGQTTYALTKGAVSSFTKALAYEAGPYGITVNAVLPGWVRTPKVEQVAADSRPEDPESALRDMAGFIPLKRLCDIDEIGDLVAFLASDEAKYITGTEMVIDGGSTLPETFDILHA

SEQ ID NO: 162 - protein, 264 aa, Artificial Sequence
  Synthetic
MVILITGITSGFGKAMAAKLSSEGHKVYGTHRKEVEHIPGVTYITAEVTDDAQVEAAVRQVIDTEGRIDVFINNAGMGIGGPLEFSSLEDASRQMDVNWMGMVRFLHFVLPQMRRQKYGKIICFSSIGGLIGLPYQGLYSASKYAIEGYCEALRLEVKEFGIKVVVIEPGDFSTNFTAQRKCVAGSGAAMAYPSYERSLKGIEKDEMTGLKPEFLADKVSRIIRKKSPHYSYIIASPLQKLSVVAKAILPRRLFYWILSKYYNL

SEQ ID NO: 163 - protein, 251 aa, Artificial Sequence
  Synthetic
MRTILITGASGGLAQEMVKLLPEDRLILLGRNQEKLEKLYANHPQAECIGIDITDSSAIQKLVEELYQRYGQIDVLVNNAGYGIFEAFDSISDQQVREMFEVNTFALMNLSRLIGARMKTAGKGHIVNIVSMAGLVATAKSSLYSATKFAAIGFSNALRLELMPFGVHVTTVNPGPIRTTFFDQADPDGSYVKAVDRYILEPDFVAKKIVKNFGKPKRELNLPWLLNLTHKLYTLFPRISDKLASKMFNFK

SEQ ID NO: 164 - protein, 245 aa, Artificial Sequence
  Synthetic
MELTGKNVFITGSTRGIGAAVALAFAKAGANIVLNGRKAIPEEKINEIKAQGVNCIGVSGDISDYEKAGLMVEEAEKQLGSIDILINNAGITNDKLLMRMSAEDFKACLDINLTGTFNMTQHVLKKMMKKREGAIINLSSVSGLIGNVGQANYAASKAGVVGFTKSVAREAAARGVTCNAIAPGFIATDMTEVLSDKVKEQVVKQIPMQRFGSVEDVANAAIFLAESPYITGQVINVDGGLVMHG

SEQ ID NO: 165 - protein, 322 aa, Artificial Sequence
  Synthetic
MLFFILNITCKVIKNIFYVIINMNGGFFMDLKKLFGYEGKTVVITGSASGMSKSATELLLKLGAKVYAIDIKSIDLPVEKAFKADLSKKEEIDEVISQLPEKIDSLFLCHGIAQFPGRELLVQKVNFYSQKYMTEKLLDRINEHGSVTYISSVGGFGWQQVYNKAVELINLPTWEDAMEWYDKNPELIKSAYVFAKQCLESYVTYKCMSPEFINKRIRINAINPGDTTTGLTEDFNKSSSPTGNAKEGEEIISNIFLKSWNGYPAEPKDMGYPMVVVGSDICSYMSGQLIYIDFGLTSTWTSGALLQANEKSIEEISRESNE

SEQ ID NO: 166 - protein, 264 aa, Artificial Sequence
  Synthetic
MDLQLTGKTALVTGATAGIGLAIARTLAQEGVAVTLTGRDPAKLQKAASSITDATPDAQVSTVVVDLGTLEGAEALFAACPDTDILINNLGFYEAKAFADINDEDWLRMFNTNVMSGVRLSRHYFPRMLERNWGRVIFISSEVGAFTPPDMVHYGVSKSAQLAVSRGMAELTRGTGVTVNSVLPSATRSDGIIEYLRQTAPAPDMTDREIEAHFFQTYRPSSLIARMIEADEIAAMVALLASPLGAASNGAAVRVEGGTFRSIL

SEQ ID NO: 167 - protein, 251 aa, Artificial Sequence
  Synthetic
MYQYNDLKAKTVLVTGASGDIGLAICAKFLDQDCDVYALYKSNAVQLTELKETHPAGNKLSIIQCDLADPQSVSALCAHLTQAAGKLDVLVNNAGIVKDSLFASMSFDDFSQVVDTNLFSIFRLTKEALMLLRSAESPAIINVASIAAIIPSVGQANYSASKGAILGFTRTLAAELAPYGVRVNAIAPGMIESKMVKKVSRTVVRGVTASIPLRRLGKCDEVANTVVYLGSTASSYIVGQTIVIDGGLVMR

SEQ ID NO: 168 - protein, 245 aa, Artificial Sequence
  Synthetic
MFELHDKVALITGAAGGLGDKIARTLHKQGATLALTDMRAEPMEKLKAELGDRVEVFTANLTNPEDVKNLVAQVEEKLGRIDILVNNAGLTRDNLFIRMSDEDWQLVLDVNLSAGFKLAKAAVRGMMKRRFGRIIGIASVVGVTGNAGQANYSASKAGMIAMNKCLAQEVGSRGITVNSIAPGFIRTPMTDVLPDDVKAALLAKIPEGKLGEAQDIANVVAFLASDEAQYITGQTININGGMAMI

SEQ ID NO: 169 - protein, 322 aa, Artificial Sequence
  Synthetic
VHLLDLNIYKRSNKKEDIAIIHSLSELILITFNQRIPPLFYCFYIGIACYETKHSDILFIFAGNTRNMQPQVILITGASSGFGKITAQMLSERGHIVYGTSRKPSEDMNQVKMLVVDVTNSFSVCQAVERILLEQGRIDVLINNAGIGIGGALELATEEEVNIQMNTNFFGVVNTCKAVLSSMRKARKGKIINISSIGGVMGIPYQGFYSASKFAVEGYSEALALEVHPFHIKVCVVEPGDFNTGFTDNRNISEQTRLDADYGESFLKSLEIIEKEERNGCHPRKLGAAICKIVERTNPPFRTKVGLMFLKHSLSDCLRKSL

SEQ ID NO: 170 - protein, 264 aa, Artificial Sequence
  Synthetic
MQNQFSLNGKIALVTGASYGIGFAIASALAKAGATIVFNDLKQEFVDKGLSAYKEAGINAKGYVCDVTNEDQVNTMVAQIEKEVGVIDILVNNAGIIKRIPMIEMSAAEFRQVIDVDLNAPFIVAKAVIPSMIKKGHGKIINICSMMSELGRETVSAYAAAKGGLKMLTRNIASEYGEYNIQCNGIGPGYIATPQTAPLREKQADGSRHPFDSFIIAKTPAARWGTPEDLEGPAVFLASHASDFVNGHVLYVDGGILAYIGKQP

SEQ ID NO: 171 - protein, 251 aa, Artificial Sequence
  Synthetic
MRTIIITGASGGLAQEMVKLLPNDQLILLGRNKEKLGQLYGKHPHVELIEIDITDDSALETLAADLYLRYGKIDVLINNAGYGIFEEFDKISDKAIHQIFEVNTFALMNLSRRLGARMKENRKGHIINIVSMAGLIATSKSSLYSATKFAAIGFSNALRLELIPYGVYLTTVNPGPIRTAFFDQADPDGTYLKSVDRFLLEPDAVARKIVKIIGKNKRELNLPVLLNLAHKFYTLFPKLADKLAGETFNYK

SEQ ID NO: 172 - protein, 245 aa, Artificial Sequence
  Synthetic
MFNLDGKIALITGAAGGLGDKIARTLHAQGATLALTDMRAEPMEKLKAELGSRVECFTANLTNSDDVHNLVKEVEEKMGRIDILVNNAGLTRDNLFMRMSDEDWQLVLDVNLSAGFKLAKAAIRGMMKRRYGRIIGIASVVGVMGNAGQANYSASKAGMIAMNKCLAQEVGSRGITVNSIAPGFIRTPMTDVLPDDVKAQLLNKIPEGKLGEAQDIANAVAFLASDEAQYITGQTLHVNGGMAMI

SEQ ID NO: 173 - protein, 321 aa, Artificial Sequence
  Synthetic
MDLSAFNLQGKVALITGGAHGIGFSIAEGMAKCGAAICFNCSSEASLEKGLAAYKAAGIDAHGYVADVSDEDAVNAMVAKIKAEVGPVDILVNNAGLMKRVPMIEMSHADFMRVIDVHVGGAFNCSKAVLPDMMEKREGKIINICSMMSELGRETVSAYAAAKGALKMLTKNIASEYGEYNIQCNGMGPGYIATAQTAPLREVQPDGSRHPFDQFITAKTPAGRWGEPDDMVGPCVFLASHASDFVNGQILYADGGILAYIGRQPSKAIWALRLLQPSDQTALCRPKSAWGCFLQSGKRPFLQNFASCQLMLKCSNFMSNW

SEQ ID NO: 174 - protein, 264 aa, Artificial Sequence
  Synthetic
MVNFSLEGKVALVTGASYGIGFAIATAFAQAGAKIAFNDIKQELVDKGIASYKELGIDAKGYVCDVTKEEQVQELVKKVENDLGPINILVNNAGIIKRIPMCEMKAEEFRQVIDVDLNAPFIVSKAVIPSMIKQGGGKIINICSMMSELGRETVSAYAAAKGGLKMLTRNIASEYGEYNIQCNGIGPGYIATPQTAPLRERQADGSRHPFDAFIVAKTPAARWGTTADLQGPAVFLASSASDFVNGHVLYVDGGILAYIGKQPK

SEQ ID NO: 175 - protein, 251 aa, Artificial Sequence
  Synthetic
MRTIIITGASGGLAQEMVKLLPNDQLILLGRNKEKLAQLYGNHPHVELIEIDITDDSALEALVADLYLRYGKIDVLINNAGYGIFEDFNKISDQDIHQMFEVNTFALMNLSRRFAERMKESRKGHIINIVSMAGLIATSKSSLYSATKFAAIGFSNALRLELMPYGIYVTTVNPGPIRTAFFDQADPDGTYLKSVDRFLLEPDAVARKIVKIIGKNKRELNLPVLLNLAHKFYILFPKLADKLAGGIFNYK

SEQ ID NO: 176 - protein, 245 aa, Artificial Sequence
  Synthetic
MKRAVITGATGGIGGKTAEVLGLAGYEVIVTGIDEAGRQAVMSNLESKGVKAHFYFCDATNEEQVNETFAKIAQEFDSIDLLVNNVGGLGGRQRVSEMETSFMRKVMALNFDSLFFNTRAALPLLKKGTNPSIINFSTIAVTNGGGIGASVYAASKGAVQSYSRALAKDLAEFGIRVNMVSPGTIDTPFHAATDRKLVESWKDSILMKRLGDPREVADVIEFLASDKASFLTGEVIQINGGQAFI

SEQ ID NO: 177 - protein, 320 aa, Artificial Sequence
  Synthetic
MRRGEVAKGSAWALVTGAGSGIGRCFALRLARLGYRLVLVGNDLRKLESVQAELRALDAAEVRVISCDLARAEAARELYERVRAAGIDVDVLINNAGIFSFRDILRTPAERIERVIMLHCLTATQLCRLFARDMAARNGFAANPEAEPRAVTDMATPATQTGECSGTQSVPATPTGDRPGTQPAPRHAKRRFHILNMASYSLWMPFPGLTLYSASKAYLKCFSVAFAKEVREAGIRVTAVCPAGVATNLYGLTPRWQRIGLRLGVLISADHCARRGLWALWHGRRCSVPDWWNRLWIPLCKLLPMCVIRPIRNFTMKFQK

SEQ ID NO: 178 - protein, 264 aa, Artificial Sequence
  Synthetic
MIPAIKNMKNAFDLTGKNVVITGGNRGLGLGIAEAMAQSGANVAILCRDSAKAQEALETLRAYGGNHMAFNCNITNLTSVNETAKQVAEQFGGVDILVNNAGVSCVNELLDMDEQLTDWYNVVNTDLNGTVHMTYAFGKLMRDAGKGGAIINIASNAAFIVNKTQAMSPYSTSKAAVCHFTHCMAVELGKYNIRVNAIAPGFFNTELSKFIPADQFDYINNQMPLGRFGEPIEVGALAVFLASPAAAQITGTVQVIDGGYILSC

SEQ ID NO: 179 - protein, 251 aa, Artificial Sequence
  Synthetic
MYNYNDLVDKTVLVTGASGDIGHAICGKFLEQGCVVYALYCTNKAQLMELQSHHPAGKKLHLLQGDLSSQEDVAAICAQLSSDKGKLDVLVNNAGIVKDNLFAAMTFDDFSSVINTNLLGLFRLTKEVLLLLRSAQNPAIINVASIAAIVPSIGQANYSASKGAILSFTRTLAAELAPRGVRVNAVAPGMIESKMVKKVSRTVVREVTNSIPLKRLGKCEEVADTIVYLSSSASSYIVGQTIVIDGGMVMR

SEQ ID NO: 180 - protein, 245 aa, Artificial Sequence
  Synthetic
MFRLDGKVALITGAAGGLGDKIARTLHAQGAVLALTDMRAEPMEKLKAELGGNVEVFVANLTNPEDVKNLVKNVEEKLGRIDILVNNAGLTRDNLFIRMSDEDWQLVLDVNLSAGFKLAKAAVRGMMKRHFGRIIGIASVVGVTGNAGQANYSASKAGMIAMNKCLAQEVGSRGITVNSIAPGFIRTPMTDVLPEDVKAALLAKIPEGKLGEAQDIANVVAFLASDEAQYITGQTININGGMAMI

SEQ ID NO: 181 - protein, 315 aa, Artificial Sequence
  Synthetic
MNLKGKTVLITGGASGIGKIMGRICLEKEVAHLVIWDVNPDNIRRTEIELAGILGSDTKKPNADTRATMVGHKNRIHSYQVNCADADAVARTYSKVVDEVGQADVLINCAGIVRGNNTFDKQTVKDIDLTMDVNATAPMLVALQALPDMIKRDSGCICNIASAAGMLGVPKMSVYCASKWAVIGWTESMRIELKLAGSKVKVMSVAPYFIDTGMFDGVQSKIFPILKPEKVAAKVIRAIEKGKNFKGIPFPYHFIRFWQGILPIAVFDFIFGKCFGVYSVMDHFTGRRNIQENGNEALNIKSKSLTLRRNIHKAS

SEQ ID NO: 182 - protein, 264 aa, Artificial Sequence
  Synthetic
MPERAKDKVVVVTGATAGIGRAAAAMFKARGAKVVCLARRRSEEFDSIQTDVTDRDAVNAAVSEIVKKYGRIDVLVNNAGMGISGAAEDTDQATVRKIFELNFFGALNMIQAVVPVMRSQGGGSIVNVSSVAAELAIPFQSFYSATKAALSSLSAALRNELRPFGIKVTAVLPGDVKTDFTSSREKNAADDPAYGDRIARSVAVMERDERNGMSPDVIAKLIVRGALEKNPPVSRVGGAKYVLLVRLAHILPKRLVSYILSKLY

SEQ ID NO: 183 - protein, 251 aa, Artificial Sequence
  Synthetic
MAETILVTGASAGFGQAICRRLVADGHRVIGAARRIEKLQALHEELGEAFYPLQMDVTDLTQVDQALASLPKAWEQIDVLVNNAGLALGLAPAHEAEIADWLSMIQTNIIGLTYLTRQILPQMVERNDGYVINMGSTAGTVPYPGANVYGASKAFVKQFSLNLRADLAGKQIRVTNIEPGLCEGTEFSSVRFKGDEKRVEALYRDAHAIQPEDIANTVSWLIQQPKHVNVNRIEIMPVSQTFGPQPVYRGD

SEQ ID NO: 184 - protein, 245 aa, Artificial Sequence
  Synthetic
MEKKVAVVTGASRGIGAAIARELAAAGMYVVINYCGSEEKAQELKTEIGQNGGEASIYKCDVSDNVACKEFIGNVIAEYGHLDVLVNNAGITRDGLLMRMSEEDFDAVLDTNLKGAFHTIQAVSRQMLKQRSGRIVNISSVVGVSGNAGQANYAASKAGIIGLTKAVAKELGSRGITVNAVAPGFIETDMTEVLSDEIKVGLKASIPLGTLGHVEDVAKTIAFLASDDAKYITGQTIHVDGGMAM

SEQ ID NO: 185 - protein, 315 aa, Artificial Sequence
  Synthetic
MNLKGKTVLITGGASGIGKIMGRICLEKEVAHLVIWDVNPDNIRRTEIELAGILGSDTKKPNADTRATMVGHKNRIHSYQVNCADADIVAETYSRVISEVGDVDMLINCAGIVRGNRTFDRQTVQDINLTMDVNATAPMLVALQVLPDMIKRKSGCICTIASAAGMLGVPKMSVYCASKWAVIGWTESMRIELKLAKSKVKVLSVAPYFINTGMFDGVQSKIFPILKPEKVAAKVIKAIEKGKSFKGIPFPYHFIRFWQGILPIAVFDFIFGKCFGVYSVMDHFTGRRNIQENGNEALNIKSKSLTLRRNIHKAS

SEQ ID NO: 186 - protein, 264 aa, Artificial Sequence
  Synthetic
MVNFSLEGKVALVTGASYGIGFAIATGFAQAGATIVFNDIKQELVDKGLAAYKEIGIEAHGYVCDVTNEDAVNNMVAQIEKEVGVIDILVNNAGIIKRIPMCDMTAAEFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGNPEDLMGPAVFLASDASNFVNGHVLYVDGGILAYIGKQPK

SEQ ID NO: 187 - protein, 251 aa, Artificial Sequence
  Synthetic
MRTIIITGASGGLAKEMVKLLPEDRLILLGRNQEKLEDLYAGHPQAECIGLDITDSSTVQKLVEELIQRYGKIDVLVNNAGYGIFEEFDQITNEQIHAMFEVNTFALMNLSRMIGAHMKEAGKGHIVNIVSMAGLVATAKSSLYSATKFAAIGFSNALRLELMPFGVYITTVNPGPIRTSFFDQADPDGTYVKAVDRYILEPDFVAKKIVNTFGKAKRELNLPWLLNLTHKLYTLFPRISDKLASKMFNYK

SEQ ID NO: 188 - protein, 245 aa, Artificial Sequence
  Synthetic
MRLEGKTAIVTGAGRGLGKGIALKLAQEGASVMICDMVEENAQSVVKEIEASGGKASYQICNVAVLDEVNALFEKTLSTYGKVDILVNNAGINRDSMLHKMSVEQWDQVIAVNLTGTFYMTQAAAKLMREQESGAIINISSASWLGNVGQANYAASKAGVVGLTKTAARELAKKGVTCNAICPGFIETDMTRGVPEKVWDIMVGKIPMGRAGKPSDVANMVAFLASEEADYITGEVINVGGGMVL

SEQ ID NO: 189 - protein, 253 aa, Artificial Sequence
  Synthetic
MKALITGASSGIGRDMARILAKKNYNLVLVARDEQKLKELEKELKENKNIKIETISMDLSQEENCIDLHKSVKDVDILINNAGFGDCGNFTHTELNKELSMIKTNIIAYHILTKLYLVDMKAKNSGKILNVASIAGFMPGPLMATYYSTKAYVVRLSESIREELRKEKSKVQISILCPGPVNTNFNNVANVKFHMREASSYEVAKFAIKKLLKGKFYIIPGLDVKTGIFFSHFVPSSFVAKITYMVQKRKLEK

SEQ ID NO: 190 - protein, 264 aa, Artificial Sequence
  Synthetic
MRLGLKGKTVVITGGAGGIGKEAAREFLKEGASVAVFARTKAKVEGFCREMEGQGYHNVYGEALDVTDKEGVRCFMETVCRRFGTVDVWINNAGIAIDKPFLEYTEDEWDAIMNTDLKAVWNCIGLVAPIMMKQESGVIINISSFAAKIPSAGGAIYGAAKSGVSSLTRTLAAELAPYHIRVLGVVPGMIDTEISKSNIAENGERLVQNVSMGRLGTAEDLAGPIVFLASDQAGYMTGFDLEVTGGKFAVQNTRQAWHAKERLT

SEQ ID NO: 191 - protein, 251 aa, Artificial Sequence
  Synthetic
MKTAIITGASAGLGREFLRHLPMLFPDIEEYWLISRSKDKLTEAAREVPRQCRIFPLDLTLDESYEKFAAELERLKPEVWMLINNSGCGFLGNVGEGELKKQTQMVDLNLKGLTAMTHVTLPYMHKGGCVINVSSIASFCPNPRMTVYSASKAYVTAFTFGISEELKARGITATAVCPGPMDTDFIKVGGIKGNSKTFDVLPYCDPAKVAYGALVAAGYGKTIYTPTAFYKFYRVLAKLTPTKLMMKLSKT

SEQ ID NO: 192 - protein, 245 aa, Artificial Sequence
  Synthetic
MNFKGKTALITGAAVGIGRAVAIKMAQNNAKLVLADLNFEKLEALKAELAAYTNDVLICKCDISHESDVRLMTESAYATFGSIDILVNNAAVWRQCSPFQNIELSEWQRYFDINIIGTVSVTKSVIGKMLKNKYGRIINVASVAGVYGNANMTTYSATKGALISFTRALAKEVSDKGILVNSVSPGSVSPSENDDINYTEPSELSFIGRTGSDMENANLICFLASDDASYISGQNIQIDGCRKKQ

SEQ ID NO: 193 - protein, 313 aa, Artificial Sequence
  Synthetic
MGLSEKILAQPRSSTPSSSFWLSHIARYAPEPARRNLAHCCDPDVNKFCGMGSKTAVVTGASSGIGLCFSKELAGRGYDLVMVSNQREELERAAAELNGTNGIKAVPFYCDLTAPDAHTQITSFLDENGIDADVLINNAGIFSFDMVTDTPERKINCFLDLHCRAVTMLSREFAERFKKRGSGRILNMSSMSCWMPMPGIAMYSATKAYIRVFSRALHYEMCDSGVSVTVACPGGIATDLFGLPPNLMKLAVRIHAVQTPEKFVHKAVNKMLRGKKQYINGFINRLAIVAVGMTPTGVRMLIKHKMLDRDIKR

SEQ ID NO: 194 - protein, 264 aa, Artificial Sequence
  Synthetic
MVNFSLEGKIALVTGASYGIGFAIATAFAQAGAKIVFNDIKQELVDKGLAAYREKGIEAHGYVCDVTNEDAVGAMVAKIKQEIGTIDILVNNAGIIKRIPMCEMSAAEFRQVIDVDLNAPFIVSKAVIPGMIEKGHGKIINICSMMSELGRETVSAYAAAKGGLKMLTRNIASEYGEYNIQCNGIGPGYIATPQTAPLRERQADGSRHPFDAFIVAKTPAARWGTPEDLMGPAVFLASDASDFVNGHVLYVDGGILAYIGKQPK

SEQ ID NO: 195 - protein, 251 aa, Artificial Sequence
  Synthetic
MRTIIITGASGGLAQEMVKLLPNDQLILLGRNKEKLAQLYAKHPNVEWIEIDITDDSALEALVADLYLRYGKIDVLINNAGYGIFEDFDQISDQDIHQMFEVNTFALMNLSRRLGARMKENRKGHIINIVSMAGLIATSKSSLYSATKFAAIGFSNALRLELMTYGIYVTTVNPGPIRTGFFDQADPDGSYLKSVDRFLLEPDAVARKIVKIIGKNKRELNLPVLLNLAHKFYILFPKLADKLAGGIFNYK

SEQ ID NO: 196 - protein, 245 aa, Artificial Sequence
  Synthetic
MRLENKTAIVTGAGRGLGKGIALKLAAEGAKVIAADMSMETATATADEINASGGTAKAFAVNIAKQDEVKAMMDFTVESFGTLDVIVNNAGINRDAMLHKMTAEQWDQVIAVNLTGTFYCVQYAAQIMREKGSGAIINISSASWLGNIGQANYAASKAGVVGLTKTACRELARKGVTCNAICPGFIDTDMTRGVPEKVWDTMISKIPMGRAGSPADVANMVAFLASDEADYITGEVINVGGGMIL

SEQ ID NO: 197 - protein, 309 aa, Artificial Sequence
  Synthetic
MKTGRPPVHSGKMKRPDSSPPPRFSPLFFHSRHAPSPYGFLRGQVHFKLAGTVKNGFTVGSMQKLAGKTAIVTGAGRGIGNAVARRFASEGARVILISRSPSSCGGAAEEINKEFPDSCKAYPCDVADYAAVQETMAAILKDFPQIDILVNNAGITRDSLMLRMKEEDWDAVLDTNLKSAFNTVKALQRVLMKSPAGRIINMSSVIGLVGNIGQANYAASKAGLIGFTKSLAQEFAPRKVTCNAIAPGFISTEMSNAIPDNLKEEIVKKIPLKEQGSVEDIAALTAFLASDDARYITGQVIACDGGMTM

SEQ ID NO: 198 - protein, 264 aa, Artificial Sequence
  Synthetic
MLNLENKICIVTGSTSGIGLGIAEYLLEHGAVVFVSGRTLAHMDNARAKLAKYGDRAHYELVDLCNYKRAEAYVKRVGDENGHIDYVFANAGGGTVTRFEEITWEMWEDIIGSNFLGAVAAFKAAVPFMKSQNEGHLVVTSSLAGYSVNPYQASYVATKHAVYGMIQSLHYELEKYNITCQAICPGFVRTPIFTRNGEPEEAIPPQCISVEEAVEEIFAGIENGDITIKVCKESRAYYDAIRNNPEFCDLEMRNLAAFYELQLP

SEQ ID NO: 199 - protein, 251 aa, Artificial Sequence
  Synthetic
MAETVLITGASAGFGKAMTETFIHSGYRVIGAARRLEKLGKLREALGEHFYPLQLDMTDTSSINKALANLPKEWSKIELLVNNAGLALGLDKAYEANFKDWETMIATNIIGLTYLTRQILPDMVARKSGHIINIGSTAGTYPYPGGNVYGASKAFVKQFSLNLRADLAGTKVRVTNIEPGLCGSTEFSTIRFKGDKKRAEQLYEGAHSIQPQDIANAVLWTFQQPKHVNINRIEIMPTSQSFGPQPVEKDY

SEQ ID NO: 200 - protein, 245 aa, Artificial Sequence
  Synthetic
MKEKRVFITGGAHGIGRSIVDRFCQQGNQVVFCDIDDTHSLKTAYETGAHFIHADVSVKEELEATMKTVLNKWGDIDILINNAGISTFKPLTQTTVDEFDHVINTNLRSAFITSQILARHRQDQSKRNDYGRIINLCSTRYLQSEPGTEAYSASKGGIWSLTHALAVSLAPLHITVNCIAPGWIHVNEQETLRPEDHAFHLSGRVGKPEDIARTCLFLCEPENDFINGQCITVDGGVTKTMIYPE

SEQ ID NO: 201 - protein, 308 aa, Artificial Sequence
  Synthetic
MNSDEFILEVPTELRMRRSRRRKEDIMNSDEFILEVPAELRMRRKQRKKEDIPYSQYNIEERSFIMYKTVLITGASRGIGRAIACAYAREGCRLVINCSRSEKELLALADELRETCHVDVLTSIGDVSDYAYMEQLFSQSEARFGGVDILVNNAGISHIGLLEDMTIDEWNRIIGVNLTSVFSASKLALPHMIHQKSGKILNISSIWGNVGASCEVAYSACKGGINSFTRALAKELAPSNIQVNAIACGVIDTEMNACFSAEERAQLAEEIPAGRFGAPEEVASLAVQLTTGNDYLTGQIITLDGGYL

SEQ ID NO: 202 - protein, 264 aa, Artificial Sequence
  Synthetic
MVNFSLEGKVALVTGASYGIGFAIATGFAQAGAKIVFNDIKQELVDKGLAAYKELGIDARGYVCDVTNEEAVNALVAQIEKEVGVIDILVNNAGIIKRIPMCEMSAAEFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGNPEDLMGPAVFLASDASNFVNGHVLYVDGGILAYIGKQPK

SEQ ID NO: 203 - protein, 251 aa, Artificial Sequence
  Synthetic
MSEQDLTGKIALVTGASRGIGHAIAMELAAHGATVIGTATSEAGAEHITQDLAKVRSDAGKGIVLNVADADRSREVIDEVQKEFGAIHILVNNAGITQDQLAMRMKDEDWDKVIDVNLTAVARLSRGVLRGMMKAKEGRIINITSVVGSIGNAGQMNYAASKAGVESMSRALAREVGSRNITVNCVAPGFIDTDMTKSLPEEVVTGMLKQIPLARFGNPEDVAAAAAFLASPKAAYITGTVVHVNGGMFMN

SEQ ID NO: 204 - protein, 245 aa, Artificial Sequence
  Synthetic
MKNVLVTGGTGGIGSAIAERFAQNGYNVAVHTHRKHEKAKSLADELRQKYGIKTTAVSADVSCHHSVSKMFDIIETELGEIDVLINNAGIAQQKLFTDISDEEWHKMLGVNLDGVFFCCKEALKRHMIKNHIGVILNISSMWGQVGASCEVHYSAAKAGVIGLTKALAKEVGLSGIRANCICPGVIMTDMMKGFDEDTITALKDETPLNQLGTPQDIAETAVFLCSDKAKFITGQILGVNGGFII

SEQ ID NO: 205 - protein, 308 aa, Artificial Sequence
  Synthetic
MKETYSFGRDTYIYDYKMGAGKKISNYIPLAPQQEQKNVVGIESIMIPKPIFDDPNYCGSNKLRGKVIILTGGDSGLGRAAAIAFAKEGANLVIPYYNEDDDANLTKKIIEYYGTKCLLMKGDLSSKKFCKEVVKKTIEYFGKVDVLVNNAGVQYQADSLEEISDEQFDWTMKVNIYGMFYLTKECLPYLKEGSSIINLSSITTFKGDPQLIDYVTTKGAIIGFTRSLARNLALKKIRVNAIAPGFFWTPLQPNCWVKEKIPTLGADAAMGRGAMPYELAPTYVFLASNDSSYMTGQVIHVNGGEIMG

SEQ ID NO: 206 - protein, 264 aa, Artificial Sequence
  Synthetic
MVNFSLEGKVALVTGASYGIGFAIATAFAQAGATIVFNDIKQELVDKGLAAYKEKGIEAHGYVCDVTDEAAVNAFIAQVEKEVGVIDILVNNAGIIKRIPMCEMTAEQFRQVVDVDLNAPFIVSKAVIPSMIKKGHGKIINICSMMSELGRETVSAYAAAKGGLKMLTRNIASEYGEYNIQCNGIGPGYIATPQTAPLRERQPDGSRHPFDAFIVAKTPAARWGTPEDLMGPAVFLASDASNFVNGHVLYVDGGILAYIGKQPK

SEQ ID NO: 207 - protein, 251 aa, Artificial Sequence
  Synthetic
MRTIIITGASGGLAQEMVRLLSNDRLILVGRSKNKLEKIYGEKENIDLVELDITDSSALERFAERIDSQYGHIDVLVNNAGYGIFEEFDKISSSDIESMFEVNTFALMNLSRLFGSRMKKAGQGHIINIVSMAGLIASSKSSLYSATKFAAIGFSNSLRLELLPFGVYVTTVNPGPIKTAFFDLADPDGSYVKAVDKYILEPDFVAGKIVNVFGKKKREINLPGILNLAHKFYTLFPRIADKLAAKMFNYK

SEQ ID NO: 208 - protein, 245 aa, Artificial Sequence
  Synthetic
MKTAVITGASGGIGSAIALAFASNNYNVVLQYNHNSKKAISLANKIQEKFNVTALAVKADVSSSQEVEKMFDFIAAKLGNVDVLINNAGIAQQKLFTDITDDDWHKMIGTNLDGVFYCCREVLKRFMIKNHSGVILNISSMWGQVGASCEVHYSAAKAGVIGLTKALAKEVGLSQIRVNCIAPGVVMTDMMKCFDEQTVNELKEETPLNTLGQPQDIADAALFLCSDKAKFITGQILGVNGGFII

SEQ ID NO: 209 - protein, 307 aa, Artificial Sequence
  Synthetic
MICVYWLLLTGLPKWIFVLIRFTSIHLGIASKKGDEKMSEKFNMNQFSLTGKVALVTGASYGIGFAIASAYASAGATIVFNDINQELVDKGIQSYKELGIEAHGYVCDVTNEEAVNAMVKKIENDVGVIDILVNNAGIIKRIPMCDMSADDFRKVIDVDLNAPFIVSKAVIPSMISKGHGKIINICSMMSELGRETVSAYAAAKGGLKMLTRNIASEYGEYNIQCNGIGPGYIATPQTAPLRELQEDGSRHPFDQFIISKTPAARWGNPEDLMGPAIFLASDASDFVNGHVLYVDGGILAYIGKQPQ

SEQ ID NO: 210 - protein, 264 aa, Artificial Sequence
  Synthetic
VSEKVCVITGGTSGIGKCTAEAMRRKGYAVYELSRRETGVAGFVHIPTDVTKPEMVDAAIAEVLRQEDHIDVLINNAGFGVSGAVEFTEPAAAKKQLEVNFFGMVNVCHAVLPVMRGAGHGRIVNLSSVAGVVPIPFQTYYSASKAAINSYTMALANEVKPFGVQVCAVMPGDIRTGFTAAREKSQAGDDVYHGRIARSVAGMEHDEQTGMSPEAAGAYIASVATRRSVKPLRSIGLKYKFFCVLAKLLPVRTLNWLVGLIYAK

SEQ ID NO: 211 - protein, 251 aa, Artificial Sequence
  Synthetic
MTKIALVTGASAGFGKAIVKKLVADGYQVIASARRLEKLQSLQAELGSDKVYPLQMDVSEPKLIDQALASLPETWQHIDLLVNNAGLALGLDKAYEADFTDWMTMINTNIVGLVYLTRQVLPDMVKHNSGMIINLGSTAGTIPYPGANVYGASKAFVKQFSLNLRADLAGTKIRVTNIEPGLCEGTEFSNVRFKGDDERTEKLYEGAHAITPEDIANTVSWVASQPEHVNFNRIEMMPVSQTYGAQPVYRD

SEQ ID NO: 212 - protein, 245 aa, Artificial Sequence
  Synthetic
MKRFQNKVSLVTGGNRGIGRAIALRLASEGSGIILFGRNEKDNQSVEKEITDTIGVPVKSYVVDISSKKSVEEGVKAAISHFHRIDVLINNAGICRLSTPFAEVKEEEWAETLSVNLYGVIYTTKLVIPYLEKEGGKIINIASLAGEVGGIATSADYVASKAALQGITKSLARELGPKHINVNAIAPGFVRTQMTEKMSINLSSIPLRQVAEPEDIAAAAAFLASDDARLITGTTLDVNGGLYMN

SEQ ID NO: 213 - protein, 307 aa, Artificial Sequence
  Synthetic
LAHIDKLMASYDVHQSGHFGYTKIIKYELNKWRLIMSSKVILVTGASSGMGFETAKALAQQGNKVYGAARRVEKMAALKEYGVTPLKLDITDEASNKAAIAEIIAKEGRIDVLINNAGYGSYGAIEDVDLAEAKRQFDVNLFGLAALTKNVLPYMRAQYSGKIINVSSMGGRLVSFMGGWYYATKYAVEAFSDALRMEVKQFGIDVILIEPGGIKTDWGHIAADHLADSAKGGAYEKTALKVAEGMHKQYNGNMMGKPQVVVKATVKAVNARRPKPRYLIGFGAKPLVFVHAILPTRVFDFIMMHAS

SEQ ID NO: 214 - protein, 264 aa, Artificial Sequence
  Synthetic
MVNFSLEGKVAWVTGASYGIGFALATAFSEAGAKIVFNDISRELVDKGLAAYKELGIEARGYVCDVTSEEQVNALVAQIEKEVGVVDILVNNAGIIKRIPMCEMTAEQFRQVIDVDLNAPFIVSKAVIPSMIKKGHGKIINICSMMSELGRETVSAYAAAKGGLKMLTRNIASEYGEFNIQCNGIGPGYIATPQTAPLREVQSDGSRHPFDSFIISKTPAARWGTPEDLMGPAVFLASDASNFVNGHVLYVDGGILAYIGKQPK

SEQ ID NO: 215 - protein, 251 aa, Artificial Sequence
  Synthetic
MAETILVTGASAGFGLAICRRLVADGHRVIGAARRLDKLTALQEELGTAFFPLQMDVTDPSQVDHALASLPKAWERIDVLVNNAGLALGLAPAHEAEIVDWLTMIQTNIIGLTYLTRQILPQMVERNDGYVINMGSTAGTVPYPGANVYGASKAFVKQFSLNLRADLAGKQIRVTNIEPGLCEGTEFSVVRFKGDEKRVEALYRDAHAIQPEDIANTVSWLIQQPKHVNVNRIEIMPVSQTFGPQPVYRGD

SEQ ID NO: 216 - protein, 245 aa, Artificial Sequence
  Synthetic
MKHTILVTGSSRGIGRAAAERFAREGHRVALHCHERRAEADALCASLAAGGCSVMAVQGDVADEADVDRLFAQVRERFGPVDVLVNNAGIAPPEQLLTDCTAALWDRVFAVNVRGAFLCCRAALPDMIRKKRGSIVNVSSVWGVVGGSCETPYSASKAALIGLTHALAKEVGPSGVRVNCVAPGYIETEMNAALTDAEREAIRQDTPLQLLGAPEDAAAAIAFLALDEGRFLTGQVLGCDGGWNG

SEQ ID NO: 217 - protein, 305 aa, Artificial Sequence
  Synthetic
MSEERMINTTIVITGASSGFGRGAALALAKRGANVVLAARRGEALEALAQEINADNGHALAVETDVSQPDQVERLAQAAIARFGPINVWINNVGVGALGWFWEIPVADHERLVDVNLKGVIYGAHVAMKHFIAQGFGVLINTGSVDSEVPLAFQSSYAATKAAVLSLGRTINEELRLNEYHDIKVATIMPWAVDTPWWTHAANYTGHAPRMAAMDPPEKVIDAMVKACFKPQEEIPVGWKARSSNLSHHLFPDMTEKLSAKVINRSVEKAQPLAPTTGAIYTPMADTTTIDGGIRARMKQEDKAR

SEQ ID NO: 218 - protein, 264 aa, Artificial Sequence
  Synthetic
MVNFSLEGKVALVTGASYGIGFAVATAFARQGARIVFNDIKQELVDKGLAAYKEEGIEATGYVCDVTNEEQVNAMVARIEKEVGTIDILVNNAGIIKRIPMIEMSAAEFRQVIDVDLNGPFIVSKAVIPSMIKKGHGKIINICSMMSELGRETVSAYAAAKGGLKMLTRNIASEYGEYNIQCNGIGPGYIATPQTAPLRERQPDGSRHPFDSFIVAKTPAARWGTTEDLMGPAVFLASEASNFVNGHILYVDGGILAYIGKQPK

SEQ ID NO: 219 - protein, 251 aa, Artificial Sequence
  Synthetic
MRTIIITGASGGLAQEMVKLLPEDRLILLGRNQEKLEDLYAGHPQAECIGLDITDSSAVQKLVEELTQRYGKIDVLVNNAGYGIFEEFDQITNEQIHAMFEVNTFALMNLSRMIGAHMKTAGKGHIVNIVSMAGLVATAKSSLYSATKFAAIGFSNALRLELLPFGVYVTTVNPGPIRTSFFDQADPDGSYVKAVDRYILEPDFVAKKIVKNFGKPKRELNLPWLLNLTHKLYTLFPRISDKLASKMFNYK

SEQ ID NO: 220 - protein, 245 aa, Artificial Sequence
  Synthetic
MKRFQNKVSLITGGNRGIGRAIALRLASEGSGIILFGRNEKDNHAVEKEIEDTIGVPVKSYVVDISSKKSVEEGVKAAISHFHRIDVLINNAGICRLSTPFTEVKEEDWEETLSVNLYGVIYATKLVIPYLAKEGGKIINIASLAGEVGGIATSADYVASKAALQGITKSLARELGVKHINVNAIAPGFVHTQMTEKMSINLSSIPLRQVAEPEDIAAAAAFLASDDARLITGTTLDVNGGLYMN

SEQ ID NO: 221 - protein, 302 aa, Artificial Sequence
  Synthetic
LQFQALGTIVNGEVQRGTKVKAFVSFFAFRKLRKVRGVMGKLEGKVAVITGASKGIGEGIAKVYAKYGAKCVLAARGPKVLELAEQLKSEGYEATGVQVNVSDYKSVEKLVEVAENTYGKIDVLVCNAGVCVLEDFLEDDTFENRDLHLDINVKGAWNVAKAVIPSMIANGGGAIVVTSSVTGDMVADPGEVAYATSKAALVGFTKALAREFADKNIRVNAICPGYVRTPLVEGMAKQSDPENPERAIQAIADAVPLKRLADPEEVGELAAFLGCYESSYITGTQIVIDGGSTLPETTSMGQ

SEQ ID NO: 222 - protein, 264 aa, Artificial Sequence
  Synthetic
MKALSGKGRAALVTGARRGIGLGIAKALLAEGYAVLLCGVTEEPRATADIAPELTRLGTWAYLRCDVSDAQDREALFAGMEERFGRLDVLVNNAGVAPVQRLDVLETTAESFERLLRVNTESCFFMCQAGAKRMLAGKAQGIPDYRPRIINISSVSAYTSSPSRGEYCVSKAGISMVTKLFADRLAGEGIPVFEVRPGIIQTDMTAGVADKYRRMIEQEGVTPIRRFGQPEDVADQVLAACSGLLDFGTGTVLNADGGFHLRRL

SEQ ID NO: 223 - protein, 251 aa, Artificial Sequence
  Synthetic
MIGYGMENKRGVISGGTSGIGLAAARMLVQDGATVWLVGRDPERGKKALESLEGLPGKALYLQGDVSTVEGCRKIAACLQQHHQELDFLVNSAGIYQEKPFQDVTEEEYQQLMDVNVKGTIFLTQALLDLFAQDGPSIVNIASDAALEGNYGCCLYAASKGAVVAFTRSLALDLAPWIRVNCLCPGDMDTPLVEKQLAEGGYSRESMASVYPLGRIGKPEEAAHMICAVLSPLNGFMTGAIISVDGGLTAK

SEQ ID NO: 224 - protein, 245 aa, Artificial Sequence
  Synthetic
MFELHDKVALITGAAGGLGDKIARTLHKQGATLALTDMREEPMLKLKAELGDRVEVFTANLTNAEDVKNLVANVEEKLGRIDILVNNAGLTRDNLFMRMSDEDWQLVLDVNLSAGFKLAKAAVRGMMKRRFGRIIGIASVVGVTGNAGQANYSASKAGMIAMNKCLAQEVGSRGITVNSIAPGFIRTPMTDVLPEDVKAALLAKIPEGKLGEAQDIANVVAFLASDEAQYITGQTININGGMAMI

SEQ ID NO: 225 - protein, 302 aa, Artificial Sequence
  Synthetic
MEKSQNTFALVTGASSGMGLEYARQLAAKGHNILVVSNRDEDNRKVAEMLHSEYGVSAVPYYADLSKSESSQALYDWTKENGYVVDILVSNAGMLVFNKLFNTPARMVDLIVGVHCLATTHLCRLFGGDMKERAEKLSAERVAAAVAAGAKPESRRARRAGRLKRGEVGRILIMASLSAYLPYPTISVYSATKAYLKSLGTSLWHEMRDYGVTVTTICPSAVDTPLIKLAPNLRKLAHNLGLMIYPKTLVRKALTAMFHGRRILVPTVIAKLAVVFCSLLPQHCVYWIAHIPVLKKNVLDKV

SEQ ID NO: 226 - protein, 264 aa, Artificial Sequence
  Synthetic
MKDSLRNKVVVITGASSGIGRSIALESAGRGATVILIARRKDRLEEITAEAKELSGAEAYVFPTDMGKPESIEKTFDEITKQVKHIDFLVNCAGFGKFEEFMEQKMQDVTNMFQVNVLGLMYFTRLIGRVMMDQKTGQIINFGSIAGKVPTTKSAAYSASKAAVIQFSNVLRLELKPFGVKVMTVNPGPVYTNFFNVADKTGNYVKNVQEFMLDPDDVAWQVVHFFGSDKRELNLPLSLAVLAKLYNLFPTIGDKISLEFASRK

SEQ ID NO: 227 - protein, 251 aa, Artificial Sequence
  Synthetic
MENIAGKTALVTGASQGLGRVIALELAKAGCRVIVNYANHSGNAEKVVAEITAAGGTAEPFRCDVSDEPAVHAMFAALEERFGGVDILVNNARIDPWRREASMSEGEWFDRVLSINLKGALLTSVAFMPKAMERRYGRIVNVSSVRAFRAAEPNMIAYGVSKLGMHGLTRAFAEQGAPFNVTCNTVAPGMILTENIAKRLTPEKYAEECFAIPMRRGGTAEEIADAVLFPIRNGYVTGETININGGMYYAP

SEQ ID NO: 228 - protein, 245 aa, Artificial Sequence
  Synthetic
MNGKIALVTGGSRGIGRAIALQLAKDGCDVAILYAGRKEAADETVALLEQTGHRALAIQCNVADGAAAEAAVKEVEAQLGPIAVLVNNAGIVRDGLAMRMSSEDFRAVLDVNLTGAFHMIRACLPLFIRRRAGSIVNITSVSGMMGNPGQANYASSKAGLIGLTKTIAREVASRGITVNAVAPGFIQTDMTAGMNEAALQKGLAAVPMGRIGKPEDVANAVSFLASDAASYITGCVLKVDGGMYI

SEQ ID NO: 229 - protein, 302 aa, Artificial Sequence
  Synthetic
LITFVLPFKAKSMADNYIERQYEQYNAKKAAWEKARKYGKKPTAITHSVKPEQPVAGPDKKRVFITGGADGIGKAIVKAFSETGCLVAFCDCNATLGEQTSKETGATFYLVDVSDKEALEKCMQHVFKNWGDIDVLINNAGVSRFSPITETEVEDFDRILSINLRPVFITSRQLAIHRKSLPTPNPYGRIINICSTRYLMSEPGSEGYAASKGGIYSLTHALALSLAEWHICVNSIAPGWIQNHDYEQLRQEDHDQHPSRRVGKPEDIARMCLFLCQKENDFINGENITIDGGMTKKMIYLE

SEQ ID NO: 230 - protein, 264 aa, Artificial Sequence
  Synthetic
MVNFSLEGKVALVTGASYGIGFAIATAFAKAGATIVFNDIKQELVDKGLAAYKEEGINAHGYVCDVTNEEAVNALVAQVEKEVGVIDILVNNAGIIKRIPMCEMSADQFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGNPEDLMGPAIFLASDASNFVNGHVLYVDGGILAYIGKQPK

SEQ ID NO: 231 - protein, 251 aa, Artificial Sequence
  Synthetic
MRTILITGASGGLAQEMVKLLPEDRLILLGRNQEKLEQLYASHPQAECIGIDITDSSAVQDLVEELYQRYGQIDILVNNAGYGIFEAFDRISDQQVQEMFEVNTFALMQLSRLMGAHMKEAGKGHIVNIVSMAGLVATAKSSLYSATKFAAIGFSNALRLELMPFGVHVTTVNPGPIRTTFFDQADPDGTYVKAVDRYILEPDFVAKKIVKNFGKPKRELNLPWLLNLTHKLYILFPRISDKLASKMFNFK

SEQ ID NO: 232 - protein, 245 aa, Artificial Sequence
  Synthetic
MSLSGKIALVTGASRGIGRAIALRLAADGANVAVIYAGSAEKAEAVCAEIRALGAEAKAYRCDVASAEAVKETVKAVTADLGKIDILVNNAGITRDNLVLSMKDEDYDAVLDTNLKGAFNMIRACYSGFIRKKSGRIINISSVSGIMGNAGQANYAASKAGLIGLTKSVARELASRGVTCNAVAPGFIQTDMTENIGEDNTLRTMIPLGRMGQPEDIAAAVAFLASDAAAYITGEVLRVDGGLAI

SEQ ID NO: 233 - protein, 301 aa, Artificial Sequence
  Synthetic
MTHKKQSVSIIRQGVMELDTYKSNYIQKNYVDGKVIIVTGASSGFGMLTAKRAAEWGGKVVLAARNEDKLKEAVSAIREAGGEASYVVTDVAKREDVFNMAKFAVDTYSRIDVLVNNAGTMPLAFFSDHEQALDKWEQCLDISLKGTLFGICAVYDQMIKQGSGHVINISSIYANFPLAGAGVYQVAKMGVQYLADSLRSECQGKIKVTTVKPTGFMRTNLSGSVINQMAIMPAMTMPTEAMVKWIEEQPLRPDFHDINSMSYNDPDPQILADNILYAINQPLGVDVGDITVRCSNDMFII

SEQ ID NO: 234 - protein, 264 aa, Artificial Sequence
  Synthetic
MRKLEGKVAIITGASKGIGEGIANVFAKYGAKLVLVARGEKVQKLAERLREQGTEVIAVQADVSKRAEMEQLAKTAIDTFGTIDVLVSNAGICILEDFIEAEDDTVRDMHFDINIKGTWNAVKAVLPEMIRKESGKIVVMSSVTGDLVADPGEAAYATSKAALVGFTKAMAREVAMHHINVNAICPGYVRTPLVEGMAQQSDPEDPERAIAAIADAVPLGRLAAPEEIGELAAFLSCEESSYITGTQIVIDGGSTLPETSSMGQ

SEQ ID NO: 235 - protein, 251 aa, Artificial Sequence
  Synthetic
MRFDNKVVVITGAGNGMGEAAARRFSAEGAIVVLADWAKEAVDKVAASLPKGRAMAVHIDVSDHVAVEKMMNEVAEKLGRIDVLLNNAGVHVAGSVLETSVDDWRRIAGVDIDGVVFCSKFALPHLLKTKGCIVNTASVSGLGGDWGAAYYCAAKGAVVNLTRAMALDHGGDGVRINSVCPSLVKTNMTNGWPQEIRDKFNERIALGRAAEPEEVAAVMAFLASDDASFINGANIPVDGGATASDGQPKIV

SEQ ID NO: 236 - protein, 245 aa, Artificial Sequence
  Synthetic
MELTNKNVFITGSSRGIGFGIAEAFAKEGANIVLNGRKEIPQTLIETITRFGVKCIAVNGDISEYDQAVSMLAQAEAELGPIHILVNNAGITNDKLLLRMKPEEFESVLKINLTGTFNMTQVALKKMMKLREGRIINLTSVVGLTGNIGQANYAASKAGVIGFTKSVAREGAARGITCNAIAPGFIETEMTAVLSDKVKEQSINNIPLQRFGAVEDVAKAAVFLAQSAYITGQVVSVDGGMAMQG

SEQ ID NO: 237 - protein, 300 aa, Artificial Sequence
  Synthetic
MSFRSGGKVQDLAFFYEIKEKNKFPFAEHFVPLTENTRMNELQKGKTMKGKLIFITGATSGIGEACARKFAAMGSNLILNGRNTEKLEALKKELTAQGVEVLTLPFDVRNREEMRRAVDSLEGKWQQIDVLVNNAGLVLGMDKEHEGSLDEWDIVIDTNIKALLAMTRMIVPGMVERQRGHIINIGSIAGDAAYAGGSVYCATKAAVKALSDGLRIDLVDTPLRVTNVKPGMVETNFSVVRFRGDKDKADAVYNGIRPLTGEDIAEVVYYAASAPEHVQIAEVLVMPTYQATGTVCHRQL

SEQ ID NO: 238 - protein, 263 aa, Artificial Sequence
  Synthetic
MVNFSLEGKVALITGASYGIGFALATAYAQAGAKIVFNDIKQELVDKGLAAYKAEAIDAKGYVCDVTNEDQVNAMVAQIEKEVGVIDILVNNAGIIKRIPMHEMKASEFRQVIDVDLNAPFIVSKAVIPSMIKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASDASDFVNGHVLYVDGGILAYIGKQP

SEQ ID NO: 239 - protein, 251 aa, Artificial Sequence
  Synthetic
MSKIVLVTGASAGFGIAIVKTLVADGYQVIACARRFDKLQELQAELGQDKVYPLQMDVAQPKAIDAALDSLPEQWRAIDVLVNNAGLALGLDKAYEADFTDWMTMINTNIVGLIYLTRQVLPDMVKRNSGLIINLGSTAGTVPYPGANVYGASKAFVKQFSLNLRADLAGTKIRVSNIEPGLCEGTEFSNVRFKGDDERVAKLYEGAHAIQPEDIANTVSWIASQPEHVNINRIEIMPVSQTFGAQPVYRD

SEQ ID NO: 240 - protein, 245 aa, Artificial Sequence
  Synthetic
MGKLDGKIALITGGTSGIGEASAKLFAEEGATVIVVGRNKNKGAEIEKEIQKYNPKSFYFECDITSNNQIGDLRKKIEEVFGRLDILFNNAGILETGALEDLTYEKWNSVYEINTTAPVMMCKNFMELLIKSHGVILNNASIDGLQYNARGRAYMYATSKAALIQFTQVLALNYSDTVRVNCICPGTTKTNLFTNKDYSRFIDKIPMKRVAESIEIAKVALFLVSDDASYITGANIVVDGGSSLL

SEQ ID NO: 241 - protein, 299 aa, Artificial Sequence
  Synthetic
VSGQHGGRGEVPGAPDREQNEKHKQEIMKQYFKDKVVVVTGASSGIGEALAREFAAEGGRVVLGARSLQKLQHIVDEIRARGGQAACCAVDVTKPEECRELIATAVREFGGVDILLCNAGISMRALFDDVELDVLHRLMDVNFWGTVNCCKYALPYLQASHGSIVGVSSVAGLHGLPGRTGYSASKYAMTGFLETLRIENLKKGLHVMIACPGFTASNVRFSALTADGSQQGETPRDESKMMTAAQVARIIARGVRHRKRLCLMEAEGRATHFVKKFAPAFLDRMFYLVMSREPDSPLK

SEQ ID NO: 242 - protein, 263 aa, Artificial Sequence
  Synthetic
MGKLTGKTALITGASQGIGEGIARTFARHGANLILLDISPEIEKLADELCGRGHRCTAVIADVRDPASVTAAIKRAKEKEGRIDILVNNAGVCRLGSFLEMSDDDRDFHIDINIKGVWNVTKAVLPEMIARKDGRIVMMSSVTGDMVADPGETAYALSKAAIVGLTKSLAVEYAQSGIRVNAICPGYVRTPMAENIARQSNPQDPESVLTEMAKAIPLRRLADPLEVGELAAFLASDESSYLTGTQNVIDGGSTLPETVSVGI

SEQ ID NO: 243 - protein, 251 aa, Artificial Sequence
  Synthetic
MRTILITGASGGLAQEMVKLLPEDRLILLGRNQEKLEKLYASHPQAECIGIDITDSSAVQDLVEELYQCYGQIDILVNNAGYGIFEEFDQITNEQIHAMFEVNTFALMQFSRLMGANMKEAGKGHIVNIVSMAGLVATAKSSLYSATKFAAIGFSNALRLELMPFGVHVTTVNPGPIRTTFFDQADPDGSYVKAVDRYILEPDFVAEKIVKNFGKPKRELNLPWLLNLTHKLYTLFPRISDKLASKMFNYK

SEQ ID NO: 244 - protein, 245 aa, Artificial Sequence
  Synthetic
MAKTAVITGSSRGIGAAIALRLAKDGMNIAFNDLNMTMFENNDIVDRVKALGVEAEIFCADVSKYDQCEEMVKKVKERFGTIDVLVNNAGITRDGLMARMPEEQYDMVIAVNQKSVFNMTKFVGNVMMRQRSGHIINLASVAGLYGNPGQINYSASKAAIIGMTKTVAKELGSRNVTCNAVAPGFIHTPMTDKLTDDQKAAMLAQIAMKRYGEPEEIASVVSFLASEDSSYVTGQVIEISGGISM

SEQ ID NO: 245 - protein, 299 aa, Artificial Sequence
  Synthetic
MSWIKNKNVIITGVSTGIGKELAKLFVNKYHCKVLGVARSVGKLEALKAELGENFSFYPMDISSRENWEAFAAGAATEFKPDILINNAGMIHPFANICDLSDRDVERTVNTNYLSHIYAARTMIPVLEKSAYPGYVNIASASALLPVAGQSIYSSTKAAVYAMSECIRQEYEGEGWYVGYVLPGPVKTDLYNAKASDGAEAKAKVKDGLITKIGQTAPHAAKVICRCMARRQSRIVLGAVAHLMGFGHQLFPRTVPSMASKLMSVLPLQSFKDIFKNTKANKAARKAQRKALKAEKKAK

SEQ ID NO: 246 - protein, 263 aa, Artificial Sequence
  Synthetic
MVNFSLEGKVALVTGASYGIGFAIATAFAKAGATIVFNDIKQELVDKGLAAYEAEGIKAHGYVCDVTNEEQVNAFVAQVEKEVGVIDILVNNAGIIKRIPMVEMTAAEFRQVIDIDLNGPFIVSKAVIPSMIKKGHGKIINICSMMSELGRETVSAYAAAKGGLKMLTRNIASEYGEYNIQCNGIGPGYIATPQTAPLRERQADGSRHPFDAFIVAKTPAARWGTPEDLMGPAVFLASDASNFVNGHVLYVDGGILAYIGKQP

SEQ ID NO: 247 - protein, 251 aa, Artificial Sequence
  Synthetic
MRTIVITGASGGVAQEMVKLLPNDQLILVGRSLEKLTKLYSNHAHCELVELDITDYKALEAFTEEIYQKYAQVDVLVNNAGYGIFEEFDKISNEDIHAMFEVNTFALMNLSRLFGEQMKQAGHGHIVNLVSTAGLIASAKSSLYSATKFAGIGFSNALRLELMPYNVYVTTVNPGPIKTAFFDKADPDGSYVKAVDKYILEADVVAKQIVDNFGKKKRELTMPFALKAAHKLYTLFPNIGDKLASKMFNYK

SEQ ID NO: 248 - protein, 245 aa, Artificial Sequence
  Synthetic
MLGNKTVFVTGSSRGIGKAIAALFAVEGYNVAIMCRSSKRELEETEKELKVYNPNIMALMGDLGEYKTARNAVEEIERNFGCIDVLVNNAGISYVGLFNTMRPEEWKRVIDTNLNAVLNCTHAAIQNMIRTHRGNIINISSMWGELGASCEAVYSATKGAVNSFTKAMAKELAPSNIRVNAISCGVIDTKMNSFLSPSERMSLKEEIPLGRFGNAEEVAKLALYLAENDSSYITGQVISIDGGMS

SEQ ID NO: 249 - protein, 298 aa, Artificial Sequence
  Synthetic
MINNYNIINNSENTDDCNVMDNSENTDNCDVIDNSADIDNCGVINNSVNADNCSVMDNTTIIITGASRGIGRAIAIALASPSTNLVISCSKSEAELQETYDAVVKKGAHCTAYVGDMGNYSNVLEMFDLALSHYGKTDILINNAGIASIGLFQDMTPDMWNNIMSVNLNSVYNCCHFAVNDMLRRHSGKIINISSVWGLYGASCEVAYSASKGAINSFTKALAKELAPSHIQVNAIACGAIDTSMNGHLSKEELDELACEIPAGTLGKPEGVARLVKLMLESDDYLTGQVIQYDGGWI

SEQ ID NO: 250 - protein, 263 aa, Artificial Sequence
  Synthetic
MMKVCIITGASSGIGRAAAENMLKRGYKVYGISRRGGDIDNVVSLCADVTDEQEIIKAVDTVMAESGRIDVLINNAGFGISGAVEFTRTEDAECQFNVNFFGAVRMCRAVLPIMRKQGFGRIVNIGSVAGDIAIPFQSFYSAAKAALCSYTLALINEVREFNITAVCIEPGDIRTGFTAARNKNTQGDDIYNGRISRSVEKMEKDEQTGMLPENAGKYIAKIASKQSGKPVLIIGAQYKAVGILKKILPLRLINRIVGAIYAK

SEQ ID NO: 251 - protein, 251 aa, Artificial Sequence
  Synthetic
MRTIVITGASGGVAQEMVKLLPNDQLILVGRSQEKLTKLYSNHAHCEFVELDITDYKALEAFTEEIYQKYAQVDVLVNNAGYGIFEEFDKISNEDIHAMFEANTFALMNLSRLFGEQMKQAGHGHIVNLVSTAGLIASAKSSLYSATKFAGIGFSNALRLELMPYNVYVTTVNPGPIKTAFFDKADPDGSYVKAVDKYILEADVVAKQIVDNFGKKKRELTMPFALKAAHKLYTLFPNIGDKLASKMFNYK

SEQ ID NO: 252 - protein, 245 aa, Artificial Sequence
  Synthetic
MKRFQNKVSLITGGNRGIGRAIALRLASEGSSIILFGRNEKDNQSVEKEISTTYGVPVKSYQVDMSSRKSVEEGVKEAVSHFQRIDVLINNAGICRLSTPFTEIKEEDWKETLSVNLYGVIYVTGLVIPYLEKEGGKIINIASLAGEVGGIATSADYVASKAALQGITKSLARELGVKHINVNAIAPGFVRTQMTEKMSIQLSSIPLRQVAEPEDIAAAAAFLASDDARLITGTTLDVNGGLYMN

SEQ ID NO: 253 - protein, 297 aa, Artificial Sequence
  Synthetic
MTHNKSIRQEVIELETYKSNYIQKNYVEGKVIIITGASSGFGKLTAKRAAEMGGKIVLAARSEEKLKETVAEIKAAGGEASYIVTDVAKKDDVFAMAKFAVDTYGRIDVLVNNAGTMPLAFFSEHEQALDKWEQCIDISIKGTIFGISAVYDQMIKQGQGQVINVSSIYANFPVAGAGVYQVAKMGVQYLAESLRSECQGKIKVTTIKPTGFMKTNLSSSVVDQMAMMPAVAGPLEILSNWVEEAPLRPDFHDINSMTYNDPDPQVLADNIIYAINQPWGVSIGDLTVRASGESFVI

SEQ ID NO: 254 - protein, 263 aa, Artificial Sequence
  Synthetic
MKLKNKVALITGASKGIGEGIAEVFAKEGANLILCARSASTKQIADALAEKYNIKAIYVNCDVTNKADCENAVEKGMETFGQIDILVSNAGVCKLGSFLETDDNDRDFHFNVNINGCWNISQAVLPGMVKQKHGSIVIMSSVTGYMVADPGEAAYATSKAALIGLTRALAREFAEDGIRVNAICPGYVDTPMAQSIAVQSDASNPESVKAGIAGATPLKRLATPLEIGDLAAFLASDESRYITGTQVVIDGGSTLPETISVGV

SEQ ID NO: 255 - protein, 251 aa, Artificial Sequence
  Synthetic
MTDRANLEGQIAVVTGASRGIGKAIAKELAAQGATVVINYNGSEERAKEVKQTIEENGGKASIYKCNVSDFAACEAMIKDIVKEYGHLDILVNNAGITKDGLIMKMKEEDFDSVLNVNLKGTFNTIRHSARQMLKQRSGKIINISSVSGILGNVGQANYAASKAGVIGLTKTMARELGSRGITVNAIAPGFVDTEMTEVLSEEIRENACKQIILGRFGKPEDIANTAVFLASDKADYITGQVISVDGGMNV

SEQ ID NO: 256 - protein, 245 aa, Artificial Sequence
  Synthetic
MFDLTGKVALITGAAGGLGDKIARTLHAQGATLALTDMRAEPMEKLKAELGDRVEVFTANLTNAEAVKTLVDDVEAKLGRIDILVNNAGLTRDNLFMRMSDEEWQLVLDVNLTAGFKLARAAIRGMMKRRFGRIIGIASVVGVMGNAGQANYAASKGGMIAMNKSLAQEVASRGVTVNSIAPGFIRTPMTDVLTDDVKAKLMARIPAGKLGEAQDIANVVAFLASDEAQYITGQTININGGMAMI

SEQ ID NO: 257 - protein, 297 aa, Artificial Sequence
  Synthetic
MGQVVVITGAGGGLGSVFAVELAKDGKLIAVLDYDMEAAQRVAAKIREQGGTAAAVRCNVVDKNSMEQARREVREKLGKCNVLINCAGIQDPLAKTTVEAYRQGEEMDTQVSKADPDSPDSRGAARELLGKSRTLFNIDAEKMMGVMNVNWLGTVIASQVFAVDLVGVEGNSIINITSMAAYDALSMVPAYASSKAAVDMFTRWLSNYLSNEFGKVRVNAVAPGYFLTPLNHDMYVNPDGTYTQRYYNVIHRTPMGRLGDSRELVGALRFFADPDMSGYITGQVIAVDGGFLSCPGI

SEQ ID NO: 258 - protein, 263 aa, Artificial Sequence
  Synthetic
MGKLTGKTALITGASQGIGEGIARTFARHGANLILLDISDEIEKLADELAGRGHRCTAVHADVRDFASVKEAVMRAKQIEGKIDILVNNAGVCRLGNFLDMSDEDRDFHIDINIKGVWNVTKAVLPEMIARKDGRIVMMSSVTGDMVADPGETAYALSKAAIIGLTKSLAVEYAQSGIRVNAICPGYVRTPMAESIARQSNPEDPESVLVEMAKAIPMRRLACPLEVGELAAFLASDESSYLTGTQNVIDGGSTLPESVSVGV

SEQ ID NO: 259 - protein, 251 aa, Artificial Sequence
  Synthetic
MRTIIITGASGGLAQEMVKLLPEDRLILLGRNQEKLENLYAKHPQAECIGLDITDSSAVQKLVEELTQRYGKIDVLVNNAGYGIFEEFDQITDEQIHAMFEVNTFALMNLSRLIGARMKAAGKGHIVNIVSMAGLVATAKSSLYSATKFAAIGFSNALRLELMPFGVHVTTVNPGPIRTTFFDQADPDGSYVKAVDRYILEPDFVAKKIVKNFGKAKRELNLPWLLNLTHKLYTLFPRISDKLASKMFNFK

SEQ ID NO: 260 - protein, 245 aa, Artificial Sequence
  Synthetic
MRFENKVAMVTGASVGIGRACAVRLAKEGAKLVLFDINAEQLDKVKEEVAPYTTDVLTYTCDVSDEAAVNAAVADAMQHFGRIDVLINNAAIWRTWKTFMAVTTEEWKKFIDINVMGVVYCTRAVLGSMIEHHYGRIVNVGSVAGIYGNGHMSHYSATKGAIISLTAALAKEVAKDGVLVNCVSPGTVSSSKDADMDAYTSCELCYMERSGTDNENANLICFMASDEATYISGQNFQIDGCRKKI

SEQ ID NO: 261 - protein, 297 aa, Artificial Sequence
  Synthetic
MRDVVRHPVFYYLYNMADNYLERKMEEHRAGHGQVYRPKLTPSGKRQGELTFKFPPRRVLVTGGASGIGRAIVKAFCDAGCKVAFCDSDTAAGTSTAQALGARFYPLDVIDTEALEKCMQSVFDLWGDIDVLVNNVGVGNFKPLTETGIEDFDHVMHVNVRPVFVTSRRLAIHRASLHTPNPYGRIINICSTRHAMSETGTEAYSASKGAIASLTHALMMSYSGTGVTVNAISPGWIETGDTTALSAADHAQHPSGRVGVPDDIARTCLWLALPDNDFVNGENIIIDGGMTRKMIYV

SEQ ID NO: 262 - protein, 263 aa, Artificial Sequence
  Synthetic
MVNFSLEGKVALVTGAAYGIGFAIAKAFAEAGAKIAFNCRSKEHLDKALADYQAKGIEAKGYIADVTDEAQVKNLVADIERDLGTIDILVNNAGIIKRIPMLDMSVEDFRKVIDIDLNAPFIVSKAVIPGMKKKGHGKIINICSMMSELGRETVSAYAAAKGGLKMLTKNICSEFGEYNIQCNGIGPGYIATPQTAPLRERQADGSRHPFDQFIVSKTPAGRWGTPEDLMGPAIFLASDASDFVNGHILYVDGGILAYIGKQS

SEQ ID NO: 263 - protein, 251 aa, Artificial Sequence
  Synthetic
MKILEGKNAVVTGGTRGIGLAIVRTMLDTGANVAVAGSRMETAEAAVAKLIEEDPALADRLIAIAPNLNDPDSVAAAFAEVVNAFGSLDILCNNAGVSSRTPLVDYTVEEFERIVDLNLNAVFVCSQAAARIMIEQGGGAIVNTSSMVGRDGQPAGCAYPTTKFAVNGLTLSLARELAGKGIRVNAVAPGVTHTDMVDALPDEVIKPLIATIPLGRMGEPEDIANGVVFLASDMASYISGVVLPIDGLART

SEQ ID NO: 264 - protein, 245 aa, Artificial Sequence
  Synthetic
MSNKVAIVTGGSRGIGRAIVLQLANDGFDVALVYAGNTEAAQQTQADAESVGVKCKAYQCDVSDFQACGALVKNILEDFGGVNVLVNNAGITRDMLFMRMKQSEIDSVIDTNLKGAMHMAHHTCAKLMRAKDARIINISSVVGMNGNAGQANYAAAKAGLIGFTKSLAKELGGRGVTCNAIAPGAIDTEMTRAIPEKKLQELADTIPLRRIGQPEDVAKVVGFLASDAASYVTGTVIPVDGGMVL

SEQ ID NO: 265 - protein, 296 aa, Artificial Sequence
  Synthetic
MNLKGKTVLITGGASGIGKIMGRICLEKGVSNLVIWDVNPDNIKKTEVELSMYPGGDNIHSYIVNCADADAVARAYSKVTEEVGAVDVLINCAGIVRGNNTFDKQTVKDINMTMDINATAPMLVALQALPDMIRRDCGCICNIASAAGMLGVPKMSVYCASKWAVIGWTESMRIELKMAGSKVKVMSVAPYFINTGMFDGVQSKVFPILKPEKVARKVIRAIEKGKDFKGIPFSFHFIRFWQGILPLPLFDFIFGKCFGVYSVMDHFTGRRNIRGSEQVNIKTNSLSLRPHIHKAS

SEQ ID NO: 266 - protein, 263 aa, Artificial Sequence
  Synthetic
MTEKTAVVTGASKGIGFEIAKVLLKNGYKVYGLARSESSLGDVIWKKCDVGDSESVHKVFSELLEENRKIDVLVCNAGIGISGAAEFIPEEDYRLQTNVNFNGAVRCAQAVVPSMREAGSGKIVFISSLAAIFPLPFQGFYSATKAALNAFSDSLGIELKPFGIETSAVMLNDVKTEFTENRRKTVVGDDVYGGRIEASVSKMEKSEQSGMTPVQVAETVVKILKRNHLPSHKIVGVSNEFLGFLFRILPTGILMRLLKIIYG

SEQ ID NO: 267 - protein, 251 aa, Artificial Sequence
  Synthetic
MYNPFSLEGKTILVTGASSGIGRGIAVECSKMGARLIVNGRNIDRLNETLHSLEGEGHMAVQADLSKQEDIDYLVEECPSINGCVHSAGIPQISAVKHINREMLEEIVNVNEIAPILLTSQLLKKKKLLRKSSIVFIASMSGVFMANTGEGPYATTKGALSGFVKTAALELAAQGTRVNAICPGLVPTRILELSNTVFSEEQLKDTMYSRYPLKRVGTPEDIANGTIYLLSEASSWVTGVNLLIDGGYCLA

SEQ ID NO: 268 - protein, 245 aa, Artificial Sequence
  Synthetic
MKLEGRLALVTGASQGLGKSIALKLAENGADIAVIYVGDEAPALEVCREIEAMGRRAKAYFCDVRDEKAVEETVKAVSRDLGKADILVNNAGVTRDGLMLTMKDEDYDLVLDINLKGAFHMIRACYRDFMRKRYGKIINISSIAGLVGNIGQVNYAASKAGLIGLSKSVAKELGSRGVCCNCIAPGFIETAMTKDIKEDNPLLQQVPMKKMGKPEDVANVALFLASPESDYITGETIRVDGGLAI

SEQ ID NO: 269 - protein, 296 aa, Artificial Sequence
  Synthetic
MDFTGKNIVITGASSGIGLASARLLAQKGGNVYALSRRARTGERTNCGRGRIIEVGCDVTDSRSVREAFEYIFSDAENIYGLVNCAGTGIAGAVEETSEEELSGQLDCNLYGTLRALREALGRMRKQGEGRVVNMSSVGGLIGLPFQGMYSASKFALEGMTEALRNELRPFGIRVCLIEPGDVRTGFTRSRRYTAQTRESEVYRRELCSAVNAMSVSEEKGMPPEKVARLVLKALSMKNPPVRMAAGGGYKALCFIKRFLPDRLVSWVVFKMYCTRKSLGSEYWDFEKDVLGVKKG

SEQ ID NO: 270 - protein, 263 aa, Artificial Sequence
  Synthetic
MENMQEELNRSSFLTMNKVVLITGGARGIGSAIALELAKHGYDIVINYLTSKQPAKELKEKIESQYHVRCLTICADVSDVDQVNIMVSEIEEKMGGVDILINNAAVDLSNLFHLKNAEEFKRTLDVNVVGAFNCSKRVYKHMLDQEYGRIINISSTNGINTYYPMCIDYDASKAALISMTHNLAAEFGPYINVNCVAPGFIGTDNELDGYDEEFLKEETEKIMVKRYGKPEEVAYLVRFLISDEANFINNSIIRIDGGQMGSC

SEQ ID NO: 271 - protein, 251 aa, Artificial Sequence
  Synthetic
MRTILLTGASGGLAQEMVKLLPEDRLILLGRNQEKLEKLYASHPQAECIGIDITDSSAVQDLVEELYQRYGQIDVLVNNAGYGIFEAFDNISDQQVREMFEVNTFALMQLSRLIGAHMKAAGKGHIVNIVSMAGLVATAKSSLYSATKFAAIGFSNALRLELMPFGVHVTTVNPGPIRTTFFDQADPDGSYVKAVDRYILEPDFVAKKIVKNFGKPKRELNLPWLLNLTHKLYTLFPRISDKLASKMFNYK

SEQ ID NO: 272 - protein, 245 aa, Artificial Sequence
  Synthetic
MSKKTVVITGSSRGIGRACAILFAKNNYNVVINYNKSKELAEELFNDLKEAGYSVDIFKADISNRFEANSLINHCIGKFGKIDVLINNAGISQNKLFTDITDDDWNKMMGTNLNGIFYTTQKALQYMLPECSGKIINISSIWGMVGGSYEVHYSTSKAAIIGMTKALAKELGPSNIQVNCIAPGVIQTDMLNDIDEEIIEGLREETPLMRIGTVDDIANCALFLASDKSDFITGQVISPNGGFVI

SEQ ID NO: 273 - protein, 296 aa, Artificial Sequence
  Synthetic
MNNINYDCIDYDKLPKKFPPQHQDIQPGIEAKMNPKPIFDNPCYKGSEKLKGKVALITGGDSGIGRAIAIAFAKEGANVAISYLYEEIDAKATKNCVEDYGSKCILYMGDISSKSFCKSLVDCIVKDFGKIDILINNAGVQFPQESIEDISQDQLELTYNVNIFSMFYLTQAALCYMKKGSTIVNTASVTAYQGHVKLIDYSSTKGAVVTFTRSLSQSLVTKGIRVNAVAPGPIWTPLIVSSFSDEDIKKFGSDVPMKRAGHPFELAPSYVYLASEDSSYVTGQVIHVNGGTIVDS

SEQ ID NO: 274 - protein, 263 aa, Artificial Sequence
  Synthetic
MIMNDMSLQSNYDLTGKVAIITGAGDGIGKGCARLLAAAGASVVVSDIDSRRAEDVAREINEEGGKAIGVVCNVLDFGDLKKVVDTAVETFGTVNILVNNAGIGGGGRENPFKIDETYIEKVYRINVFAPLHLATLVVPEMEKSGYGSIVNITSMSSVNKEANMSIYSSSKAALNHLAANLAYDFGAMGVRINNVGPGATKTAALASILSPELESRMLSHTPLKRLGEISDIARAVLFFASPASSWVSGQTLFVNGGGIQTLD

SEQ ID NO: 275 - protein, 251 aa, Artificial Sequence
  Synthetic
MAALDFQGQTVWVTGAGKGIGYATALAFVEAGARVSGFDLAFEGDDYPFATHTLDVANAQQVAEVCGHLLKGIDRLDVLVNAAGILRMGATDELSLDAWQQTFAVNVGGAFNLFQQTMGQFRRQQGGAIVTVASDAAHTPRIGMSAYGASKAALKSLALTVGLELAGSGVRCNLVSPGSTDTDMQRTLWVSEDAEQRRIRGFGEQFKLGIPLGKIARPQEIASTILFLASDHASHITLQDIVVDGGSTLGA

SEQ ID NO: 276 - protein, 245 aa, Artificial Sequence
  Synthetic
MLDLTGKTALITGATGGIGRAIAKKMHGQGATLALTDMNMDTLKAFQAELGDRVYVYSANLTDSDSLNALVKQAEADMGKIDILVNNAGITKDGLAMRMTDAQWQAVLDINLTAGFKLARAVMPGMMKRRFGRIIGMASIVGVMGNAGQANYAASKGGLISMTKCIAQELATRGITANCIAPGFIKTAMTDALSDDVRAQLLKEVPMGRLGTAEDIANVCTFLASDEAAYITGQTINVNGGMAMI

SEQ ID NO: 277 - protein, 296 aa, Artificial Sequence
  Synthetic
MVLYTYKLIVYKSKRMYTKIKARKRRINDMDYINNYSLEGKVALVTGASYGIGFAIATAMASAGATIVFNDIKQELVDKGIAAYEEKGIKAYGYVCDVTNEDAVNEMVAKIEKEVGVIDILVNNAGIIKRIPMIEMSAKDFRQVIDVDLNAPFIVSKAVIPSMIKKGHGKIINICSMMSEFGRETVSAYAAAKGGLKMLTRNICSEYGEYNIQCNGIGPGYIATPQTAPLREKQPDGSRHPFDQFIVSKTPAGRWGEASDLGGPAVFLASDASNFVNGQILYVDGGIQAYIGKQPS

SEQ ID NO: 278 - protein, 263 aa, Artificial Sequence
  Synthetic
MGYTLITGASSGIGRELASLFAADGHDLVITARNRTALAEVKSLLERRYGVHVETFAIDLSENDAPLKLYDYTTSHGFIIDHLVNNAGFGEWTGFLDGTWRRQHEMMQLNMNALAELTYRYGRDMRDAGAGRILNVSSVASMMAGPYMAMYFASKAFVRSLSEAVAYELRGTGVTVTCVCPGPTATGFEKAAKMSGRNFFTMTRPATARQLATYAYHKMLRGRTLAYHSMFTKSGALAERVLPRCLTRRLAAFMNGGDPKRRG

SEQ ID NO: 279 - protein, 251 aa, Artificial Sequence
  Synthetic
MRYDYDGKNVIVTGATGGIGKEVAKGIIAGGGSVALIGLTLDEANKVAAELGERAHPYAMDQSNRDAVDAAFQQILNDFGRIDVLINVAGIISAKSFDELSPAEWDRTLAVNLTGPFNTVHAIWEHFKGNGGGRIVNVSSVAGKIGGGLLGTTAYASSKAGLNGFTKAIAKEGAKYGIYANAVCPSFTHTGMTAALEADLQKRQRVLSMIPLGRGAAPAEIAQMILFFGCDAASFITGEIGDCDGGIVMDG

SEQ ID NO: 280 - protein, 245 aa, Artificial Sequence
  Synthetic
MSLSGKTALVTGASRGIGRAIALRLAADGANVAVIYAGSADKAEAVCEEIRAMGVEAKAYRCDVASAEAVKETVKAVTAELGKIDILVNNAGITRDSLVLSMKDEDYDAVLDTNLKGAFNMIRACYSGFIRKKSGRIINISSVSGIMGNAGQANYSASKAGLIGLTKSVARELASRNVTCNAVAPGFIQTDMTENIGEDNTLRSMIPLGRMGKPEDIAAAVAFLASDAAAYITGEVLRVDGGLAI

SEQ ID NO: 281 - protein, 295 aa, Artificial Sequence
  Synthetic
MPPFLCDKQRQGKFSCPMIEKEKNMKDSWLDLEGKTVIVTGGASGIGKAVAQEFLNVGANVAVSDMAEKAPDLEAGQGQFAYIRTDVTKPQEVEEMVRKVTEIFGTIDVLVNNAGINIPRLLVDPKNPKGQYELDEAVWDKVCNVNLKGVFFCAQAAARVLTEKGKGVIINMSSESGLEGSEGQSVYAATKNAVNSLTRSWAKELGKQGVRVVGVAPGIMEATGLRTLAYESALAYTRGITVDDLRAGYASTSTTPLGRSGKLSEVADMCVYLASERASYVHGVTINVAGGKTRG

SEQ ID NO: 282 - protein, 263 aa, Artificial Sequence
  Synthetic
MVNFSLEGKVALVTGASYGIGFAIATAFAKAGATIVFNDIKQELVDKGIAAYEAEGIKAHGYICDVTNEEQVNAFVAQVEKEVGVIDILVNNAGIIKRIPMVEMTAAEFRQVIDIDLNGPFIVSKAVIPSMIKKGHGKIINICSMMSELGRETVSAYAAAKGGLKMLTRNIASEYGEYNIQCNGIGPGYIATPQTAPLRERQADGSRHPFDAFIVAKTPAARWGTPEDLMGPAVFLASDASNFVNGHVLYVDGGILAYIGKQP

SEQ ID NO: 283 - protein, 251 aa, Artificial Sequence
  Synthetic
MKTALITGASSGIGRDIARELSRQGWRLLLAARRRDRLEALAKELQTPCRIYVCDVSKKENCIWLHEQTRAQGVSLLVNAAGFGLFGNFSSTELNRELEMIDVNIRAVHILTKLFLRDFIKQDAGAILNVASSAGFLAGPMLSTYYASKNYVVRLSEAIYEELRASGSHVTISCLCPGPVDTEFNAAAGISKFSVKAMNSRRVARIAVRQTLAGKLLILPGISTKLSTALSRFVPEKPLLRMVHGIQKGKQ

SEQ ID NO: 284 - protein, 245 aa, Artificial Sequence
  Synthetic
MKQTVLVTGSSRGIGRAIAERFARAGHRVALHCLTRRAETEALCAALAAEGCSVMAAQGDVADEAAVARLFAAVRERFGPVDVLVNNAGVALPQQLLTDCSTADWDRLFAVNVRGAFLCCRAALPDMVRRQRGSIVNISSVWGVVGGSCETPYSASKAALIGLTRALAKEVAPSGVRVNCVAPGYIETEMNAALSEADRAAIRQETPLGVPGAPEDVAAAVAFLALEESRFITGQVLRCDGGWCN

SEQ ID NO: 285 - protein, 294 aa, Artificial Sequence
  Synthetic
MCQGLGPLTHRIAREGTRKGTDMDKIIIEPITSMKNAFSVAGQNVVITGGNRGLGRGIAQAFAECGANVAILCRNEASGNEAAEQLRLLGSRALAVKCDVGDFDSVLRAKEVVAREFDHIDTLVNNAGIDGKHGVFDDARLEEFKRVMNVNLDGVAAMIQVFGQWMMDEGRGGKIINISSIGGQAIGDPRAHPMPSYNASKAALDHLTRHLSIVMGDYGIRVNAIAPGPTHSDLDAGLPPSITRFIDETMPMHRFGEPLEIGALAVFLASPAAAQITGVVANHDGGTMCVGLTF

SEQ ID NO: 286 - protein, 263 aa, Artificial Sequence
  Synthetic
MGKLTGKTALITGASQGIGEGIARVFARHGANLILLDISDEAEKLADELGGRGHRCTAIKADVRDFASVAAAVARAKKIEGKIDILVNNAGVCRLGNFLDMSEEDRDFHIDINIKGVWNVTKAVLPEMVERKDGRIVMMSSVTGDMVADPGETAYALSKAAIIGLTKSLAVEYAQSGVRVNAICPGYVRTPMAENIARQSNPDDPESVLTEMAKAIPMRRLACPLEVGELAAFLASDESSYLTGTQNVIDGGSTLPESVSVGV

SEQ ID NO: 287 - protein, 251 aa, Artificial Sequence
  Synthetic
MLTGKSLTGQVAIVTGASRGIGKAVAQALAAEGATVIINYNGSAEAAEAVAADIRNCGGMAEAAKCNVADFAESEAFVKAVTEKYGRVDILVNNAGITRDNLIVRMTEEEFNAVLDTNLKGAFHMIRHLTKTFMKQRYGKIINISSVSGIVGNAGQANYSASKAGLIGLTKSVARELASRNVCVNAVAPGFIRTDMTDKLPEAVQDNAVGQIPLKKMGRPEDVAQAVLFLAGEASDYITGQVLCVDGGMAM

SEQ ID NO: 288 - protein, 245 aa, Artificial Sequence
  Synthetic
MKRFQNKVSLVTGGNRGIGRAIALRLASEGSGIILFGRNEKDNQSVEKEIEDTIGVPVKSYVVDISSKKSVEEGVKAAISHFHRIDVLINNAGICRLSTPFTEVKEEDWEETLSVNLYGVIYATKLVIPYLAKEGGKIINIASLAGEVGGIATSADYVASKAALQGITKSLARELGPKHINVNAIAPGFVRTQMTEKMSINLSSIPLRQVAEPEDIAAAAAFLASDDARLITGTTLDVNGGLYMN

SEQ ID NO: 289 - protein, 294 aa, Artificial Sequence
  Synthetic
VQSYIIYRDFSPYSKIHYSYEVKIISNTFAGSIDIKKNYCMMEKKIVLITGASSGIGEGCARKFAMNGYRLILNGRNVEKLNAVKKELWEKYGADVYLLPFDVRDRQAARAALESLPEEWKAIDILVNNAGLVIGVDKEHEGNLDEWDIVIDTNVKALLAMTRLVVPGMVERGRGHVINMGSIAGDYAYPGGSVYCACKAAVKALSDGLRIDLVDTPVRVTNIKPGLVETNFSVVRFRGNREAADNVYKGIRPLTGDDIAEVVYFAAAVPEHIQIAEVLVMPANQATGTIVSRK

SEQ ID NO: 290 - protein, 263 aa, Artificial Sequence
  Synthetic
MGKLTGKTALITGASQGIGEGIARTFARHGANLILLDISDEIEKLADELAGRGHRCTAVHADVRDFASVTAAVKRAKKIEGKIDILVNNAGVCRLGNFLDMSDEDRDFHIDVNIKGVWNVTKAVLPEMIARKDGRIVMMSSVTGDMVADPGETAYALSKAAIIGLTKSLAVEYAQSGIRVNAICPGYVRTPMAENIARQSNPDDPESVLVEMAKAIPMRRLACPLEVGELAAFLASDESSYLTGTQNVIDGGSTLPESVSVGV

SEQ ID NO: 291 - protein, 251 aa, Artificial Sequence
  Synthetic
MNGLDFHGQTVWITGAGKGIGYATALAFVEAGAQVTGFDLAFDGESYPFATETLDVADARQVAQVCGRLLAGIERLDVLVNAAGILRMGATDALSQEDWQQTFAVNVGGAFNLFQQTMAQFRRQKGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASVHASHITLQDIVVDGGSTLGA

SEQ ID NO: 292 - protein, 245 aa, Artificial Sequence
  Synthetic
MSKVIVITGASSGIGEATAKILAKDGAKLVLAARREDRLKKLAEEIRELGGEAVYQVTDVRDVSQVEALAEKAVSSFGRIDVWFNNAGVMPQAPLLSRDIKDWDAIVDINIKGVLYGIAAALPRMVEQKEGQIINISSVAGHFAHLNGAVYSASKWAVRAISESLREEMAGYEGNLRVTVVSPGAVHSELLNSVHNEELNKNFTAFYENFAIPAERVALTIKQAIDLPADSAWNEVVIRPTKQLL

SEQ ID NO: 293 - protein, 294 aa, Artificial Sequence
  Synthetic
MEQVIVITGAGGGLGSVFARELARDGKSIAVLDYDIRAAGQVAAQIRADGGKAAAIRGNVVDKASMEQARQEVREKLGRCNVLINCAGIQDPLAKTTAESYRPGDEMDTVVAKADPDHKETVRELLGKSRTLFNIDAERMMRVMNVNWLGTVIASQVFAADLVGGEGSSIINITSMAAYDALSMVPAYASSKAAVDMFTKWLSNYLSNEFGKVRVNAVAPGYFLTPLNHDMYVNPDGTYTQRYYNVIHRTPMGRLGDSRELVGALRFFADPDMSGYVTGQVIAVDGGFLSCPGI

SEQ ID NO: 294 - protein, 263 aa, Artificial Sequence
  Synthetic
MGKLTGKTALITGASQGIGEGIARTFARHGANLILLDISPEIEKLADELCGRGHRCTAVIADVRDPASVTAAIKRAKEKEGRIDILVNNAGVCRLGSFLEMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPQDPESVLTEMAKAIPLRRLADPLEVGELAAFLASDESSYLTGTQNVIDGGSTLPETVSVGI

SEQ ID NO: 295 - protein, 251 aa, Artificial Sequence
  Synthetic
MRTILITGASGGLAQEMVKLLPEDRLILLGRNQEKLEQLYASHPQAECIGLDITDSSAVQDLVEELYQRYGQIDVLVNNAGYGIFEVFDSISDQQVREMFEVNTFALMNLSRLMGARMKAAGKGHIVNIVSMAGLVATAKSSLYSATKFAAIGFSNALRLELLPFGVHVTTVNPGPIRTTFFDQADPDGSYVKAVDRYILEPDFVAKKIVKNFGKAKRELNLPWLLNLTHKLYTLFPRISDKLASKMFNFK

SEQ ID NO: 296 - protein, 245 aa, Artificial Sequence
  Synthetic
MKKVAVVTGVSGGIGYATAQLLLKNGVAVVGMSRSTALNEPLEGEFTYVSGDVSKREDRQNLVETTINIYGRIDILVNVAGIAPRVRADLLEMTEESYDHVMNVNTKGMMFLTQAVANEMIKITGEYKGYIVNISSLSAYASSVNRGEYCISKAGVSMITKLFADRLAEYGIMVNEIRPGIIDTNMTSKVKEKYDSLIENGLLPIKRWGKPEDVAMAVWTLCNGSLPYVTGQAIDVDGGFHIRRL

SEQ ID NO: 297 - protein, 294 aa, Artificial Sequence
  Synthetic
MEQVVVITGAGGGLGGVFARELAKDGKSIAVLDYDIHAAGQVAAQIRADGGKAAAIRGNVADKASMEQARQEVREKLGRCNVLINCAGIQDPLAKTTAESYRPGDEMDTVVAKADPDHKETARELLGKSRTLFNIDAERMMRVMNVNWLGTVIASQVFAADLVGGEGSSIINITSMAAYDALSMVPAYASSKAAVDMFTKWLSNYLSNEFGKVRVNAVAPGYFLTPLNHDMYVNPDGTYTQRYYNVIHRTPMGRLGDSRELVGALRFFADPDMSGYVTGQVIAVDGGFLSCPGI

SEQ ID NO: 298 - protein, 263 aa, Artificial Sequence
  Synthetic
MVNFSLEGKVALVTGASYGIGFALASAFAQAGAKIVFNDIKQELVDKGLAAYKAEGIEAKGYVCDVTSEEQVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGQYNIQCNGIGPGYIATPQTAPLRETQPDGSRHPFDSFIIAKTPAARWGTPEDLMGPAVFLASDASDFVNGHVLYVDGGILAYIGKQP

SEQ ID NO: 299 - protein, 251 aa, Artificial Sequence
  Synthetic
MAGLDFNGKTVWVTGAGKGIGYTTALAFVAAGAQVTGFDREFTQDAYPFATEVLDVADAAQVAQVCQRVLAQTERLDVLVNAAGILRMGATDALSAEDWQQTFAVNVGGAFNLFQQTMAQFRQQQGGAIVTVASDAAHTPRIGMSAYGASKAALKSLALTVGLELAGSGVRCNVVSPGSTDTDMQRTLWVSDDAEQQRIRGFGEQFKLGIPLGKIARPQEIANTILFLASDLASHITLQDIVVDGGSTLGA

SEQ ID NO: 300 - protein, 245 aa, Artificial Sequence
  Synthetic
MNLSGKVILVTGASRGIGRAIAIELASKGAAIAINYSKDDEGAKATLENVIKNGGYGKLFKKDISNYKNCRELIDEVIGTFGKLDVLVNNAGISKFGLLMDMSLEEINDLVNTNLMGAIYLSKLAINNMMRNGGNIINISSVWGEVGASCEVIYSATKGGLNLFTKALAKEVASFNIRVNSVAPGVINTEMNNVLDSEDKEVLKNEIPMMRFGEAHEVARVVSFLCEDKCKYLTGQIIRIDGGFI

SEQ ID NO: 301 - protein, 293 aa, Artificial Sequence
  Synthetic
MAKKSWIYGKNVLITGVSSGIGFYLSKFLCLEHGCNVVGISRNEERLKKAKEDIDLDIEKIKKDGKNSLGTFDYLVNDVSSISAWQNIKTALDGKGFKVDVLINNAGIFLPFEKFENQSLEMAKRVMETNFFAHLYSYKTFIQDIEERKGAIINIASSSALCPVVGTAVYSASKAACKNFTESLIAEHRGQLYIAYVCPGYTLTNLFREEEEMSKLVQRFSMQANKMAKKIIKRLVKKRKRIVIGLDAHLMSGLYRISPKFASWTVSAVLKGSHDAMFSKVFIENTKKGEDKK

SEQ ID NO: 302 - protein, 263 aa, Artificial Sequence
  Synthetic
MENFMNSFSLQGKVALITGASYGIGFNIARGFAAAGATIVFNDINQELVDKGLAAYKEEGIPAHGYVCDVTDEAAVNELVKKIEAEVGVIDILVNNAGIIKRIPMLEMAAADFRKVIDIDLNGPFIVSKAVIPGMIKKGHGKIINICSMMSELGRETVSAYAAAKGGLKMLTKNIASEYGEYNIQCNGIGPGYIETPQTAPLRVEGHPFNSFIISKTPAARWGKPEDLMGPAVFLASDASDFVNGHILYVDGGILAYIGKQPQ

SEQ ID NO: 303 - protein, 251 aa, Artificial Sequence
  Synthetic
MAGFDYHGKTVWVTGAGKGIGYATALAFVEAGAQVTGFDREFTLQNYPFVTEVMDVADVGQVAEVCQRLLVQTDRLDVLVNAAGILRMGATDALSPHDWQQTFAVNVGGAFNLFQQTMAQFRHQRGGAIVTVASDAAHTPRIGMSAYGASKAALKSLALTVGLELAGSGVRCNLVSPGSTDTDMQRTLWGSDDAEQQRIRGFGEQFKLGIPLGKIARPQEIANTILFLASDLASHITLQDIVVDGGSTLGA

SEQ ID NO: 304 - protein, 245 aa, Artificial Sequence
  Synthetic
MLKGKTAIVTGGTRGIGFSIVKRYLENGANVAIAGSRQESVEKAMENLGEYQGRVMGIWPNLGSPEEVAEAFASVKEKFGSLDILANNAGISSRTSLYDYTLEEFQKIVDINLTAVFICSQAAARIMKDQGGGVIINTSSMVGEYGQPSGCGYPATKFAVNGLTKSLARELAKDHIRVNAVAPGVTRTDMVAALPKEMVERISAGIPLGRMGEPLDIANAYLYLASDLASYVTGITLRVDGAAMT

SEQ ID NO: 305 - protein, 292 aa, Artificial Sequence
  Synthetic
MEDKPLHIVTGASGGIGQALTERLAKQGYRVLMACRNPEKSEPILTRIRKRSGNPEISLLPLDLGSLDSIARFAAELKARGQRIDVLLNNAGTMNGTFGLTADGFEQTVGVNCVGTAALTLALLPLMHPGSRIVNTLSCTYRIGRVDGRLFEPDPERYARFRAYGTSKLALLLFSLELRERVARQGIGVFAADPGIVDTNMITMHRWFDPIADLLFRPLIKTPEQGAETALQLACGKLPVSGNSLYWRNGKARRISDSVVNHPCRKHLWKQILQLTTRAIPETETYFRSLKY

SEQ ID NO: 306 - protein, 263 aa, Artificial Sequence
  Synthetic
MVNFSLEGKVALVTGASYGIGFALATAFAQAGATIVFNDIKQELVDKGLAAYKAEGIEAHGYVCDVTNEEQVNALVAQIEKEVGVIDILVNNAGIIKRIPMTEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREKQPDGSRHPFDAFIVAKTPAARWGTPEDLMGPAVFLASDASDFVNGHVLYVDGGILAYIGKQP

SEQ ID NO: 307 - protein, 251 aa, Artificial Sequence
  Synthetic
MNLNLLEGKTAIITGGTRGIGFAIVKKYLENGANVALCGSRQETVDKALAKLREINPDYPVMGITPNLSDPDSIASEFAKVKEAFGRIDILGNNAGVSARESIYDYDPEAFKKTMELNVNSAFFCSRAVAPIMKEQGGGVIINTSSMVSIYGQPSGCAYPTSKFAVNGLTKSLGRELAPDNIRVNAVAPGITHTDMVDVLPEEMIKPLIASIPLGRMGEPEDIANAYLFLASDLASYVTGVVLSVDGLARA

SEQ ID NO: 308 - protein, 245 aa, Artificial Sequence
  Synthetic
MEKKVALVTGASRGIGKACAIKLGSLGYDVAVNYNSNKEEADKVVETIKGFGVNAIAVQANTGDRAAVNAMFRTVTKELGKLDVLVNNAGVVDDAFLLMLAPESLDRSLDVNVKGYFYCAQAATLKMFKARTGAIVNISSVSSKMALPGQSVYAATKGAINSMTATLAAELAPYGIRVNAVAPGFIATDMVAKLPEEKKAEYLEQIPLGRFGTVEEVASLVAFLASADASYITGQVIVLDGGLSL

SEQ ID NO: 309 - protein, 292 aa, Artificial Sequence
  Synthetic
MENCNKEEAFPTSFPPQHQCRQPGIEWEMRPRPVFEDPCYTGSCRLKGKTALITGGDSGIGRAAAIAFAKEGANLAIVYLNENEDAKETKKRIEELGRECILLCGDIRRESVCRQMVESTVSEMGSLDILVNNAGVQFPQNSIEDITEEQLRTTFQVNLFPMFFFVKAALPHMKRGDCIINTASVTAYEGEADLIDYSATKGAIVAFTRSLSLSLADRGIRVNAVAPGPIWTPLIVSSFTAEKVAVFGQDVPMKRAGQPCELAPAYVYLASGDSSYVTGQVIHVNGGTITGS

SEQ ID NO: 310 - protein, 263 aa, Artificial Sequence
  Synthetic
MVNFSLEGKVALVTGASYGIGFALATAFAQAGAKIVFNDIKQELVDKGLAAYKAEGIDAKGYVCDVTNEDQVNAMVAQIEKEVGVIDILVNNAGIIKRIPMHEMKASEFRQVIDVDLNAPFIVSKAVIPSMIKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASDASDFVNGHVLYVDGGILAYIGKQP

SEQ ID NO: 311 - protein, 251 aa, Artificial Sequence
  Synthetic
MRTIIITGASGGLAQEMVKLLPEDRLILLGRNQEKLEKLYASHPQAVCIGLDITNSHALEQFVEDLTHRYGGIDVLVNNAGYGIFEEFDQITNEQIHSMFEVNTFALMNLSRIVAKRMKEAGKGHIVNIVSMAGLVATAKSSLYSATKFAAIGFSNALRLELIPFGVHVTTVNPGPIRTTFFDQADPDGSYVKAVDRYILEPDFVAKKIVNNFGKAKRELNLPWLLNLTHKLYTLFPRISDKLASKMFNFK

SEQ ID NO: 312 - protein, 245 aa, Artificial Sequence
  Synthetic
MKLEGKIALVTGASQGLGKAIALKLAENGADVAIIFVGPEEPALETKGEIEALGRKAVCYECDVRDEQAVEDTVAAVKKDLGKVDILVNNAGVTRDGLMVTMKDADYDMVLDINLKGAFHMIRACYRDFMRKRSGKIINISSIAGLVGNVGQVNYAASKAGLIGLSKSVAKELGSRGVCCNCIAPGFIETAMTKDIKEDNPLLVQVPMRKMGTPEDVANVALFLASPESDYITGETIRVDGGLAI

SEQ ID NO: 313 - protein, 291 aa, Artificial Sequence
  Synthetic
MADNYIERQYEQYEARKAAWEKKCKQGKKKTISVKLQPKDLTDNTIKLPRKAFITGGADGIGRNIVKAFCNSQYQVAFCDKNEDLGIQTTKETGAIFYHADVSNKESLENCMHELFEKWGDMDIIINNAGISEFSPITETSVEDFDKILSINLRPVFITSRTLALHRKSQAENHPYGRIINICSTRYLMSEPGSESYAASKGGIYSLTHALALSLADFHITVNCISPGWIQTNDYERLRPEDHAQHPSRRVGKPEDIARMCLFLCQEENDFINGQNIIIDGGMTKKMIYLE

SEQ ID NO: 314 - protein, 263 aa, Artificial Sequence
  Synthetic
MGKLSGKVALITGASKGIGEGIAQAFAKHGAKLVLAARSAQTQQLAQSLCEQGGEAIAVQMDVTDTASVQAGVDKALQTFGKIDVLVNNAGVCKLGAFLEQSDEDRDFHIDVNIKGAWNVTKAVVPHMIAQKYGKIVVMSSVTGDMVADPGEVAYATTKAALVGFTKAMAREVAPYNITVNAICPGYVLTPMVQGMAEQSAPDNPQSVIDGIASAIPFKRLADPVEVGELAAFLSCEESSYLTGTQIVIDGGSTLPETSDMGV

SEQ ID NO: 315 - protein, 251 aa, Artificial Sequence
  Synthetic
MEYNLDGKTVIITGGSRGIGREMVRAFAEAGANVYFTYLSNHIKAQNVQEEFGKRYHSKINSRSVDGRVGSEVKNFIEDIIKETGKIDILINCAGYISRGFFLNTTEDVWKNTLDSNVNSIFHYSKYVLKHMILQKSGCIINISSVSAHFPAKGQAAYSTSKGAIESLTKALALEYGKYNIRVNTIAPGLIETEVVKTISPKVKSEILTKTPLGRFGRADDISNLALFLSSERASYITGTQILVTGGRHLE

SEQ ID NO: 316 - protein, 245 aa, Artificial Sequence
  Synthetic
MTIQNKNVFITGSTRGIGLAIAHQFASLGANVVLNGRSQVAPEILESFQAYPGQAIAITGDISQAEEAKRMVDEAIERLGSVDILVNNAGITNDKLVLKMTEEDFESVLKVNLTGAFNMTQSVLKPMTRARQGVIINISSVVGLTGNVGQANYAASKAGLIGFTKSVAREVAARGIRVNAIAPGFIASYMTDVIPEKMQKAIVANIPMKRIGKAEEVATVATFLAEQDYLTGQVIAIDGGMTMQS

SEQ ID NO: 317 - protein, 291 aa, Artificial Sequence
  Synthetic
MKDYFGYQNKNVVVTGASSGMGKATAEMLVDLGAKVYALDWNECDVKGIRQYVHVDLSKKESIDQAMKELPSHIDSYFGIAGVSGMKNDFMTTVSIDFIANKYICEEYLIHAMSENGTIAFMTSTGGNGWEKEENKKYYIDAILASGWNATVEAIMKTGFQYLPGTLGYPYSKLAMNYYTAYLQKSFASKKIRVNAVLPGSTDTGMKSEFTEMAHGEEGLLSHCGYANRLAYSKEMAGPIVFLNSEMATYASGVLMEVDYGNTVEERANIKPVQQVISLEDIYQMIQKQSK

SEQ ID NO: 318 - protein, 263 aa, Artificial Sequence
  Synthetic
MQRLKDKVAIITGGAGGMGHVAAKTFTEEGACVVLADRDADKLQAVVKEVSAGGAKVIGVAADLTSQADREKIFEEAVKAFGKVDILINNAGWGCKLPFLETDEASFDRSIELNVKATYYMTQLACKQMIKQGTGGKIVNTSSTAALQGERNGSIYAGSKSAIIAMSKAIALEVGEYGINVNVVCPGFTRTDNNGHIPSAIDDNFLGITPTKRINVAQDIVNGYLFLVSEEARQITAQVLPIDGGFSGTRAMQAAQNASMMVK

SEQ ID NO: 319 - protein, 251 aa, Artificial Sequence
  Synthetic
MTGFDFTGKTVWVTGAGKGIGYTTALAFVDAGAKVTGFDREFTQQVYPFTTEVLNVADGGQVAEVCQRVLLQSERLDVLVNAAGILRMGATDALSAEEWQQTFAVNVGGAFNLFQQTMAQFRRQQGGAIVTVASDAAHTPRIGMSAYGASKAALKSLALTVGLELAGSGVRCNVVSPGSTDTDMQRTLWVSDDAEQQRIRGFGEQYKLGIPLGKIARPQEIANTILFLASDLASHITLQDIVVDGGSTLGA

SEQ ID NO: 320 - protein, 245 aa, Artificial Sequence
  Synthetic
MKRFQNKVSLITGGNRGIGRAIALRLASEGSGIILFGRNERDNQSVEKEITEAFGVPVKSYEVDISSKESVEEGVKAAISHFRRIHVLINNAGICRLSTPFAEVKDEEWAQTLSVNLYGVIYTTRLVIPYLEKEGGKIINIASLAGEVGGIATSADYVASKAALQGITKSLARELGPKHINVNAIAPGFVRTQMTEKMSINLDAIPLRQVAEPEDIAAAAAFLASDDARLITGTTLDVNGGLYMN

SEQ ID NO: 321 - protein, 291 aa, Artificial Sequence
  Synthetic
MKDYLGYTGKVCVVTGAASGMGKATAEMLVDLGAMVYALDWAEVKVEGITAYLHTDLSKKESIDAAFAQIPDHIDCYFGIAGVSGLGTDFLTTTKIDLISNKYISECILPARMTEGGAIAYMTSTAGIGWEQEGNKRHYLPVVEAEGWDGAVAALEKTPLIHLPGNLGYSFSKLAMNYLVAKQQALFAARKIRVNAVLPGSTDTGLKGDFLKLTGSEERLLAFTGHAHRLAASEEMAMPIVFQCSDMASYLSGDLMVVDYGSSLEVEAGIRPNAMVFTFDMILEKMAAMHK

SEQ ID NO: 322 - protein, 263 aa, Artificial Sequence
  Synthetic
MKKVCIITGASSGIGRAAAENMLKRGYKVYGISRRGGDIDGVISLCADVTDEQEILNAVNTVAEESGRIDVLINNAGFGISGAIEFTETEDAEQQFNVNFFGAVRMCRAVLPIMRKQGFGRIVNIGSVAGDIAIPFQSFYSAAKAALRSYTLALINEVREFNITAVCIEPGDIRTGFTAARHKNTRGDDIYNGRISRSVEKMENDEQNGMLPETAGKYIAEIASKQSGKPVSIIGGQYKAVGLLKKLLPLRLTNRIVGAIYAK

SEQ ID NO: 323 - protein, 251 aa, Artificial Sequence
  Synthetic
MNRLEGKVAIITGANSGVGAATAKLFAKEGAKVVISARRIEPLNEVAEEIKREGGEVLSVPTDISKKESCVAMIDAAMKEFGKVDILVNNAGVLEEGLKPIDKFEDEALDKVIDINEKGTMYCMRAALQVMQSGASIVNVASVAGIIGNGGACYVATKAAIVGVTRHTALRYADKHIRCNAICPGNILTPMTANAAGNVDMEMMGALLKHNDMKVGFCTAEQVADIILFFASDEAKPITGQAIVCDWGSTL

SEQ ID NO: 324 - protein, 245 aa, Artificial Sequence
  Synthetic
MKPNTPFSKKILIIGATSGIGKALAMMYLKNNTANIVGIAGRRTEKLKEIYDLHPTRVRYRHMDVCTEECTTIMQELLDEMGGADLIIYCSGTGSHNEGPALHPETEMPAVHTNVVGFTRIIIYAYNYFRKTGSGHFVTIASVAGIRPLRQAPAYSATKRYKIHYTSALAAMAHRNKENIRFTTIKPGFIDTELLHRKYPFMVSLEKGSRLIYNAIEKKKRSVILPGRWRWIALLWKLIPFWEKF

SEQ ID NO: 325 - protein, 291 aa, Artificial Sequence
  Synthetic
MKDYFGYQEKVVIVTGASSGMGKATAEMLVDLGAKVYALDWNICDVKGVEKFVHVDLSKKDSIDQAMKDLPKHIDSFFGIAGVSGMKNDFMTTVSIDFIANKYICEKYLIHSMTENGTIAFMTSTGGNGWEKEENKKYYIDAILASGWNATVEAIMKTGFQYLPGTLGYPYSKLAMNYYTAYLQKSFASKKIRVNAVLPGSTDTGMKSEFTEMAHGEEGLLLHCGYANRLAYSKEMAGPIVFLNSEMATYASGVLMEVDYGNTVEERANIKPVQQVISLEDIYQMMQKQSK

SEQ ID NO: 326 - protein, 263 aa, Artificial Sequence
  Synthetic
MGKLTGKTALITGASQGIGEGIARTFARHGANLILLDISDEIEKLADELAGRGHRCTAVHADVRDFASVTEAVKRAKKIEGKIDILVNNAGVCRLGNFLEMSDEDRDFHIDVNIKGVWNVTKAVLPEMIARKDGRIVMMSSVTGDLVADPGETAYALSKAAIIGLTKSLAVEYAQSGIRVNAICPGYVRTPMAENIARQSNPDDPESVLVDMAKAIPMRRLACPLEVGELAAFLASDESSYLTGTQNVIDGGSTLPESVSVGI

SEQ ID NO: 327 - protein, 251 aa, Artificial Sequence
  Synthetic
MLTGKSLTGQVAIVTGASRGIGKAVAQALAAEGATVIINYNGSAEAAEAVATDIRSHGGMAETVKCNVTDFAESEAFVKAVTGKYGRVDILVNNAGITRDNLIVRMTEEEFNAVLDTNLKGAFHMIRHLTKTFMKQRYGKIINISSVSGIVGNAGQANYSASKAGLIGLTKSVARELASRNICVNAVAPGFIRTDMTDKLPEAVQDNAVGQIPLKKMGRPEDVAQAVLFLAGDASDYITGQVLCVDGGMAM

SEQ ID NO: 328 - protein, 245 aa, Artificial Sequence
  Synthetic
MKGKNVFITGTNRGLGKAFLEEFAKRGANVIAHARQETSEFKGMCSDISTKYGVSVAPVFFDMADTSTMKSVIKDLFLKKTPVDVLINSAGILYSGMFMQTPISKFKEIFDINFFAQLELTQLILRIMMRQKSGSIINIASIGGLITYEGQIAYAASKAALISWTKNLSAECGRYGIRVNALALSLMDTGKKEEMSSKEIEYFEQRTVLGRIGTAQDAANAAVFLASDEASFINGQIIRIDGGLL

SEQ ID NO: 329 - protein, 291 aa, Artificial Sequence
  Synthetic
MVYYEESGKNAIVTGAERGIGKGIALRLAQAGYNVFFTYYFKDSYAEELKRSIEKLGRRCVALKADFRDPSVVETVVKSAAKSLGGIDLLVNNAAIMPPRAYQYEYTAEHIDEVYAVNYRGYMLLMRDALRYWIKNGKKGNIVNISSESAIRSHQKFSLYGGIKAAILRSTGNVALDAAPYGIRVNCILPGAIDTFTEQVIQDEEIPQSEVIHRRKFGDEIPLRRLGRPEEIGNAVLWLASEEAAYITGATLVVDGGLVLPGMTDITVEKDESVYGWCTQKRLSDEQMENW

SEQ ID NO: 330 - protein, 263 aa, Artificial Sequence
  Synthetic
MGKLTGKTALITGASRGIGEGIAKTFAKHGARLILLDVSPEAKTLAEELESQGYSCAAVQADVRDASQVAEAVAEGMNQMGEIDILVNNAGVCRLGNFLEMSDGDRDFHIDINIKGVWNVTKAVLPGMVKRGDGRIVIMSSVTGDMVADPGETAYALSKAALVGFTKSLAVEFAGSGIRVNAICPGYVRTPMAESIARQSDPENPESVLTEMAKAIPMRRLAAPAEVGELAAFLASDESSYLTGTQSVIDGGSTLPESVSVGV

SEQ ID NO: 331 - protein, 251 aa, Artificial Sequence
  Synthetic
MRTIIITGASGGLAQEMIKLLPEDRLILLGRNQEKLEELYAGHPQAECIGLDITDSSAVQKLVEELIQRYGKIDVLVNNAGYGIFEEFDQITNEQIHAMFEVNTFALMNLSRLIGAHMKEAGKGHIVNIVSMAGLVATAKSSLYSATKFAAIGFSNALRLELMPFGVHVTTVNPGPIRTSFFDQADPDGTYVKAVDRYILEPDFVAKKIVNTFVKAKRELNLPWLLNLTHKLYTLFPRISDKLASKMFNYK

SEQ ID NO: 332 - protein, 245 aa, Artificial Sequence
  Synthetic
MLKPLEGKTAVITGGSRGLGEAIAYKLASMGADIAVICSSSVEAGEKVCEKCIQEFGIKAKAYQCDVADFEAVKELAGLIKADFKTAHILVNNAGITRDGLAVMMKEEDFDRVIAVNLKGAFNMIRHLAGLFIRNREGCIINITSVAGIMGNAGQCNYAASKAGLIGLTKTIAKELAPKGIRCNAVAPGFIATDMTDNQTENPLLKMIPLGKMGEAEDVAEAVGYLATAKYVTGEVLRVDGGIAM

SEQ ID NO: 333 - protein, 291 aa, Artificial Sequence
  Synthetic
MRKIMLMRLFFTQLFVSEQKQIAYMADEKSPTLILHRLFTINCSETRIIMNDYIIITGASRGIGRAIAIKFAKAKYPIIIVSKNNYDDLLNAKKEIESYGSTCYAYKCDVSSYDELLNLKKSLENLKIYVSCLINNAGICDFGLFQDLDITTWNNIIATNLSSVFYMSKIFIPDMLHLQKGSIINISSVWGNVGASCEVAYSASKGGVNSLTKALAKELAPSHINVNAVACGAIDTTMNSRLTPEEKNDLEEEIPYGRMGTCEEVANLVYNIFNSPDYLTGQIITFDGGWT

SEQ ID NO: 334 - protein, 263 aa, Artificial Sequence
  Synthetic
MVNFSLEGKVALVTGASYGIGFALATAYAQAGAKIVFNDIKQELVDKGMAAYKAEGIEAKGYVCDVTNEDQVNAMVAQIEKEVGVIDILVNNAGIIKRIPMHEMKASEFRQVIDVDLNAPFIVSKAVIPSMMKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASDASDFVNGHVLYVDGGILAYIGKQP

SEQ ID NO: 335 - protein, 250 aa, Artificial Sequence
  Synthetic
MIALVTGASAGFGQAICRRLVAEGHRVIGVARRSEKLTQLREELGLENFYPLQMDVSDTKSVDQALEHLPEAWRTIDILVNNAGLALGLDKAYEADMQDWLTMIQTNIIGLVYLTRQILPQMVERDSGLIINLGSTAGTVPYPGANVYGASKAFVKQFSLNLRADLAGHHIRVTNIEPGLCEGTEFSNVRFKGDDQRAEKLYEGAHAIQPVDIANTVAWIVGQPLHVNINRIEIMPVSQTFGAQPVFREE

SEQ ID NO: 336 - protein, 245 aa, Artificial Sequence
  Synthetic
MKRFQNKVSLITGGNRGIGRAIALRLASEGSSIIISGRNEKDNQSVEEEISSAYGVPVKSYKVDMSSKKSVEEGIGQAMSHFRRLDVLINNAGICRLSTPFTEITEEDWKETLSVNLYGVIYVTGLVIPYLEKEGGKIINIASLAGEVGGIATSADYVASKAALQGMTKSLARELGVKHINVNAIAPGFVRTQMTEKMSIQLSSIPLRQVAEPEDIAAAAAFLASDDARLITGTTLDVNGGLYMN

SEQ ID NO: 337 - protein, 291 aa, Artificial Sequence
  Synthetic
MKIAIVTGASSGMGREAAIQLADRFAGLDSIWLIARREERLKELKRQLPVPSRIFEMDLTDSRQLSRLSKALQTEQPRVKFLVNAAGFGKIGRVGEVPLEEETGMVRLNCEVLTGVTHLVLPYMEKNSRIIQFASSAAFLPQPGFAVYAATKAFVLSYSRALNEEVKGRQIYVTAVCPGPVRTEFFDIAQTTGTMPLYKLLAMADPRRVVKKAIRDSVMGRSVSVYGPLMNLFFAAAKILPHSLLLAAMSALSPQKVTAPEPAEETGEGDGVSSADGRSKSKIRKSGEPDR

SEQ ID NO: 338 - protein, 263 aa, Artificial Sequence
  Synthetic
MDLGLQGKTVVVTGASKGIGYATAEAFLKEGAKVAVCSRHEDELKEAAQALSGLGEVYYEAFDVSSAAENYAFAEHVHDHFGSLDVWVNNVGATGYKKGEEYDDEEIDFMTGVCFKSVIYGCQAAFRYMKEQKKGAIVNVSSLAARCSSAGRSTLYGPLKSAVNNLTNTFAGEYCAHNVRVTCIMPGFTVTPLVKKAISQEELDRNASSTLLRRMAEPEEIAKPIVFLASDAASYMTAVTIEVSGGRSMTLNPTYAYDRLEAK

SEQ ID NO: 339 - protein, 250 aa, Artificial Sequence
  Synthetic
VEFKDKCVIVTGSARGIGREIALKFGAEGANVVVFDINIDGQAETAQAVCDEIKALGGDAKYILGDVSKPDDTDALIKFAKDEFGSVDVIVNNAGITRDNLIMRMSESDWDAVLTVNLKGAFNVIKSATRTLMKQRNGVIINMASVSGVTGNAGQANYSASKAGLIGLTKSVAKELASRNIRCNAIAPGFIRTPMTDKLSEDIQQSYKDSIPLKKFGQVEDIANLAVFLGSDKSEYITGQVINVDGGLVM

SEQ ID NO: 340 - protein, 245 aa, Artificial Sequence
  Synthetic
MMAKVVLITGASRGIGKAEAEKFARQGYQVIANFNRSEKEMKTFSDSMQKQGLALIPIQADVSNAEETQKMVDETLRQFGHIDVLICNAGIARQGLLTDFTPEDWRMMMSVNLDSVFYCCRAALPSMIRRQKGCIITTSSIWGITGASCEVPYSAAKAGVIGLTKALAKEAGPSGIRVNCIAPGVIDTQMNGNLTAEVLEELREETPLCQIGTPEQIADCAYFLAEDAASFLTGQVISPNGGFLI

SEQ ID NO: 341 - protein, 291 aa, Artificial Sequence
  Synthetic
MTFNNNENTRVWFITGASSGLGYEFTKKALESGEKVVGVARNIEKLNELKCQFEGMLLPLSLDVTDRSAVSTTVETAIKHFGRLDIVINNAGNMVMGMIEEFSEDEVRSQMETNFFGTVWVSQAVMPYLRAQESGHIIQISSIGGLISGPMSGIYSASKFALEGFSEALAQEAAHFGIKVSIVEPGGYWTNLYLKMSFTTQKKEYDSLREKLAQQYSNESVDSDPKLAAEAIMKLVNSENPPLRLVLGSLVYDLAVENAEKRIFTWKEWESVSRSSEHGIPAPEGYGIIEE

SEQ ID NO: 342 - protein, 263 aa, Artificial Sequence
  Synthetic
MNFRLDGKVALVTGASYGIGFAIAKGFAEAGATIVFNDIKQELVDKGLAAYRELGIDAHGYVCDVTDEDAVGAFVKKVEAEVGIIDILVNNAGIIKRIPMTEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREKQPDGSRHPFDSFIIAKTPAARWGTPEDLAGPAVFLASDASDFVNGHVLYVDGGILAYIGKQPK

SEQ ID NO: 343 - protein, 250 aa, Artificial Sequence
  Synthetic
MNVQNKVIVITGGAGGIGSAQAKLLARNGAEVWILDLVQEKIDQLVEELKRQGGKAHGTVADVTSEEEWKTIVERIVSESGRLDVVVNNAGINIRKPIEEMVKDEWMKMMEVNTASVFLATKYVLPVMRKQGGGAIINTSSICGLVGHMNTPEAYTATKGAITLLTKSVAARYGKDNIRCNSIHPATVDTPFVAALMADPVKKQARLNEIPLGRLTSVEDVANAVLYLASDEASFLNGVNLPIDGGVTCY

SEQ ID NO: 344 - protein, 245 aa, Artificial Sequence
  Synthetic
MKKKTVLITGGARGIGKAMSKAFAKEGYNVLVNFNKSENEAKELYTILNEKNFSVKLFKADISNREDVEDMVDYCIKEFGGLDVLVNNAGVSQDKLFTDITDEDWDNMMNINLKGSFYCSQVALKYMISEKKGNIINISSIWGISGASCEVHYSITKAGIIGMTKALAKEVGPSNIRVNSIAPGVINTDMLSGYNEEDIDALVEETPLMRLGTPEDIANCAIFLASDKSNFITGQVISPNGGFVI

SEQ ID NO: 345 - protein, 290 aa, Artificial Sequence
  Synthetic
MDFDKAYYAGKNVIVTGAASGVGLGLIEELLSYGAAKAVLADYNRENLETHAKRLSGEYPGRVKGIVCDVSKEESVKAMIDAAAEFFGGKIDLLVNNAGKGFAGFFAESSCDMEKIGKLFKMRIQTNEDWEEAFALNFYGALYGCRAVIPYMLKAGGGQVINIISGVAYSPMPLQTMYAATKAALMSMTLSLRAEYWDENIKFSPATPGTVATAIWRTENGGDLTPPTAQSPRESAAHILAGAAENKRVICGDETDEYGLKINFSPDMQDYVDKYFINVARERKSGNYTI

SEQ ID NO: 346 - protein, 263 aa, Artificial Sequence
  Synthetic
MIKVCIITGASSGIGRAAAENMLKRGYRVYGISRRGGDIDGVVSLCADVTDEQEIFKAVNTVMAESGRIDVLINNAGFGISGAAEFTETEDAERQFNVNFFGAVRMCKAVLPIMRKQGFGRIVNIGSVAGDIAIPFQSFYSAAKAALCSYTLALINEVREFNITAVCIEPGDIRTGFTAARRKNTEGDDIYNGRISRSVEKMEKDEQTGMSPETAGKYIAKIASKQSSKPVLIIGAQYKAVGLLKKLLPLSLTNRIVGAIYAK

SEQ ID NO: 347 - protein, 250 aa, Artificial Sequence
  Synthetic
MKIALITGATSGIGEGCARRFARGGYDLIITGRNTGKLEILKKELEAEGVKVLALAFDVRNREAARKAVDYIPQDWRNIDVLINNAGLARGLEPEYKGSFEDWDQMIDTNIKGLLTMTRLIVPGMVRRNHGHIINIGSVAGDAAYAGGNVYCATKAAVKAITDGLRIDVAHTKVRVTNVKPGLVETNFSNVRFHGDNQRAASVYQGIEPLNGDDIADVAFYAASAPEHVQIAEVLVLATHQANGTVIHRD

SEQ ID NO: 348 - protein, 245 aa, Artificial Sequence
  Synthetic
MKRDTVLITGSSRGIGSAIAKTLAKENYNIVINYKENETEAKKVFEEIKTYNSNVLMIQADIRKTTEVENMFNEIEKNFGNVDILINNAGIASVRFFQDITEEEWEDIFNVNVHGSYRCIKRAIPSMINNKYGKIIGISSIWGVTGGALEAHYSATKGAIISMNKALAKELGYSGITVNTVAPGGVDTDMLKDVPKESIEAYCSEFPLQRLAKPEEIADVVKFLISKEASYITGHVLNVNGGAFI

SEQ ID NO: 349 - protein, 290 aa, Artificial Sequence
  Synthetic
MVKTILITGATDGIGKHLAKKLASEGHQVILHGRNPQKLELALQEVRAVSLRGRISSYLADFSKLDDVYRFVEEIKRDFQRIDVLFNNAGLYAGKKRKASAENVELTFMLSVLVPYILTTELSSLLEKSADGRVINTSSYMHHFAKVKDLDFGFENNYHPGLAYNNSKLYTIWMTRYLARDFFLKGSNITINAYHPGLISTNLGNHSSDEKTKKSLFGRLMKSLSKDLDQGIETGYYLTLSEEVRGLTGYYFYEKKVKSVSEKGYSFEKAQKLMDYCQEKVKMFKEKQDF

SEQ ID NO: 350 - protein, 263 aa, Artificial Sequence
  Synthetic
MVNFSLEGKVALVTGASYGIGFALASAYAQAGAKIIFNDIKQELVDKGLAAYKAEGIEAKGYVCDVTNEEQVNAMVAQIEQEVGVIDILVNNAGIIKRIPMHEMSAADFRQVIDVDLNAPFIVSKAVIPSMIKKGHGKIINICSMMSELGRETVSAYAAAKGGLKMLTRNIASEYGQYNIQCNGIGPGYIATPQTAPLREIQPDGSRHPFDSFIIAKTPAARWGTPEDLMGPAVFLASDASDFVNGHVLYVDGGILAYIGKQP

SEQ ID NO: 351 - protein, 250 aa, Artificial Sequence
  Synthetic
MNWKNKVILISGGTSGIGLATARILLGKGACVVINGRDTARGEVALAQLGTLAGNCQFVPGDVSREEACRHMVQETLDYFGRLDGLVTSAGYYEEELLENVTAQSAARLFATNVYGTIFLCREALEPLKKNRGSIVMVSSDAGLQGNVGCSVYSATKGAVVSFCKSLALELAPHGVRVNCVCPGDVKTPLLSRQMAANPDETEESLRQQYPLYRLAEASEVGEVIVFLLSQAASYMTATAVPVDGGLTSW

SEQ ID NO: 352 - protein, 244 aa, Artificial Sequence
  Synthetic
MELKNKNVFVTGSTRGIGLAVAHKFASLGANVVLNGRSEISEDLLAQFADYGVTVVGISGDISNGEDAKRMVAEAIEKLGSVDVLVNNAGITNDKLMLKMSEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMIAQVPMKRIGQAEEVAEVAAFLASQEYLTGQTIAIDGGMTMQ

SEQ ID NO: 353 - protein, 290 aa, Artificial Sequence
  Synthetic
MVKTILITGATDGIGKHLAKKLASEGHHVILHGRNPQKLELALREVRAVSLRGRVSSYLADFSKLDDVYRFAEEIKRDFQRIDVLFNNAGLYAGKERKASAENVELTFMLSVLVPYMLTTELSPLLEKAADGRVINTSSYMHHFAKVKDLDFGFENNYNPGLAYNNSKLYTIWMTRYLARDFFLRGSNITINAYHPGLISTNLGNDSSDEKTKKSLFGRLMKSFSKDLDQGIETGYYLTLSEEVRGLTGYYFDEKKVKSVSEKGYSFEKAQKLMDYCQEKIKVFKEKQDF

SEQ ID NO: 354 - protein, 263 aa, Artificial Sequence
  Synthetic
MVNFSLEGKVALVTGAAYGIGLAIAKAFAEAGAKIVFNCSRQATVDRGLAAYKELGIDAKGYLCDVTDEEAVKNMVADIEKTVGTIDILVNNAGIIKRIPMEDMSCEDFRRVVDVDLIAPFIVAKACIPGMIKKGHGKIINICSMMSELGRETVSAYAAAKGGLKMLTRNICSEFGAANIQCNGIGPGYIATDQTAPLRERQADGSRHPFDQFIISKTPAGRWGTPEDLEGPAVFLASDASNFVNGHILYVDGGILAYIGKQP

SEQ ID NO: 355 - protein, 250 aa, Artificial Sequence
  Synthetic
MKIALITGATSGIGEGCARRFARGGYDLIITGRNTGKLENLKKELEAEGVQVLALAFDVRNREAARKAVDYIPQNWRNIDVLINNAGLARGLEPEYQGSFEDWDQMIDTNIKGLLTMTRLIVPGMVKRNHGHIINIGSVAGDAAYAGGNVYCATKAAVKAITDGLRIDVAHTKVRVTNVKPGLVETNFSNVRFHGDNQRAASVYQGIEPLNGDDIADVAFYAASAPEHVQIAEVLVLATHQANGTVIHRD

SEQ ID NO: 356 - protein, 244 aa, Artificial Sequence
  Synthetic
MAKVAFITGATRGIGKQIAIEFAKDGYDIAFNYRKENEDLENVKKQIKELNVRCLPVKGDVSIFDDTANMVNQIVNEFGKIDVLVNNAGITKDALLMRMKKEDFEDVINVNLVGTFNVTKNVIPYMIKQRSGRIINISSVVGVSGNAGQTNYSASKAGIIGFTKSLAKEVASRNILVNAVAPGFIETQMTDVLKQEVKEEIAKNIPLRRMGTPEDVANVVKFLAGEQSSYITGQVINVDGGMLM

SEQ ID NO: 357 - protein, 290 aa, Artificial Sequence
  Synthetic
MVEKDRNRYWRLEYMNTWFITGSSSGIGAGIAQAALELGDNVVVMARKVESLDQFVKKYPTRVLALPLELTDRTSIYAAVEQANARFGGIDILVNNAGHGYRAAVEEGESKNVAEIFQTNFFGAVELIKLILPQMREKHSGAIINISSIAAVSSGVGSGYYASTKAALELLSDALYQEVSPLGIKVMVVEPGAFRTRFYDDSLKGTQIKIADYAQTAGTRRKENIVNLHNQQGDPIKAGKVIVETIGKKDYPRTLLLGSDAVRFVRNQLQMKLEEITQWNKVSNSTDFDS

SEQ ID NO: 358 - protein, 263 aa, Artificial Sequence
  Synthetic
MVNFSLEGKVALVTGASYGIGFAIATAFAKAGATIVFNDIKQELVDKGLAAYEAEGIKAHGYVCDVTNEEQVNAFVAQVEKEVGVIDILVNNAGIIKRIPMVEMTAAEFRQVIDIDLNGPFIVSKAVIPSMIKKGHGKIINICSMMSELGRETVSAYAAAKGGLKMLTRNIASEYGEYNIQCNGIGPGYIATPQTAPLRERQDDGSRHPFDAFIVAKTPAARWGTPEDLMGPAVFLASDASDFVNGHVLYVDGGILAYIGKQP

SEQ ID NO: 359 - protein, 250 aa, Artificial Sequence
  Synthetic
MTLDFQGKNVWVTGAGKGIGYTTALAFAGAGANVTGFDLAFSQADYPFACETLDVADAAAVAGVCERLLGNNPRLDVLVNAAGILRMGATDELAPDDWQQTFAVNVGGAFNFFQQTMAQFRAQKGGAIVTVASDAAHTPRIGMSAYGASKAALKSLALTVGLELASSGVRANLVSPGSTDTDMQRTLWKSEDAEQQRIRGFAEQFKLGIPLGKIAQPQEVANTILFLASDLASHITLQDIVIDGGSTLGA

SEQ ID NO: 360 - protein, 244 aa, Artificial Sequence
  Synthetic
MELKNKNVFVTGSTRGIGLAVAHKFASLGANVVLNGRSEISEDLLAQFADYGVTVVGISGDISNGEDAQRMVAEAIEKLGSVDVLVNNAGITNDKLMLKMTEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMLAQVPMKRIGQAEEVAEVAAFLAGQEYLTGQTIAIDGGMTMQ

SEQ ID NO: 361 - protein, 290 aa, Artificial Sequence
  Synthetic
MVKTILITGATDGIGKHLAKKLASEGHQVILHGRNPQKLELATQEVRAVSLRGRVSSYLADFSKLDDVYRFVEEIKRDFQRIDVLFNNAGLYAGKERKASSENVELTFMLSVLVPYLLTTELSPLLEKATDGRVINTSSYMHHFAKVKDLDFGFENNYHPGLAYNNSKLYTIWMTRYLARDFFLKGLNITINSYHPGLISTNLGNNSSDEKTKKSLFGRLMKSLSKDLDQGIETGYYLTLSEEVRGLTGYYFDEKKVKSVSEKGYTFEKARKLIDYCQEKVKMFKEKQDF

SEQ ID NO: 362 - protein, 263 aa, Artificial Sequence
  Synthetic
MTNFSLEGKVALVTGAAYGIGLAIAQAFAEAGAKIVFNCSRQETVDRGLKAYKELGIDAKGYLCDVTDEEAVKAMVADIEETVGTIDILVNNAGIIKRIPMTEMAVEDFRRVVDVDLVAPYICAKAVIPGMIKKGHGKIINICSMMSELGRETVSAYAAAKGGLKMLTRNICSEFGEHNIQCNGIGPGYIATEQTAPLRERQADGSRHPFDKFIISKTPAGRWGTPEDLMGPAVFLASDASDFVNGQILYVDGGILAYIGKQP

SEQ ID NO: 363 - protein, 250 aa, Artificial Sequence
  Synthetic
MYMESFSNKVICITGSNRGIGKEIAFAFAQAGADLILCSRKETSENTDFINELSREYGVKIYPCYFDLEDEESVKIGLAFIKSLKLKIDVLINNAGMSHLAILPFTRISDVKRVFQVNYFSQLMITQALMSIMTKTGGGSIINMASIAGIDGDIGNSVYGATKASMILFTKVLAKEVASMKIRVNAVAPGLIDTDFAVKMGEKAIASMKEISSMHRLGTTSEIANAVLFLASEKASFVNGQVIRVDGGIK

SEQ ID NO: 364 - protein, 244 aa, Artificial Sequence
  Synthetic
MSKTALVTGSSRGIGKACALKLAELGYDIAVNCNSNLEMAQKAVDEITALGRKAVAYKANTADIDEVKDMFRSIQQDFGGIDVLVNNAGVVDDAYLLMIKDESLERSLDINIKGYFNCARQASLKMLRKKSGIIINISSVSSVLAVEGQSVYSATKGAVNAMTHTLAKELAKYGIRVNAVAPGFIETEMMNGIPEELQKKYLEAIPEKRFGTVQDVANVVGQLCSDDFSYMTGQVLVLDGGLSL

SEQ ID NO: 365 - protein, 289 aa, Artificial Sequence
  Synthetic
MRPEPDTKPNKNMTRFKDKCVLITGGGSGIGRIMGRLALERGARKVVVWDIDERNIAASLAAYAAPERTAGYRADVSDRRQVEETFARTTAECGPVEILINCAGIITGNKTFDRQTPEEIERTMAVNATAPMYLTLQALPGMLERNEGHICNIASAAGMISNPRMSVYAASKWAVIGWSDSLRIELQEARSGVHVTTVAPYYIATGMFAGVRSRLVPILDPEKTARRIVRAVEHNRTFRGLPWGFHFIRLVQGLLPDKLFDALVGNAMGIYRTMDHFTGRRTPDHTSNR

SEQ ID NO: 366 - protein, 263 aa, Artificial Sequence
  Synthetic
MDMFSLEGKVALVTGAVYGIGLAIARSLAGAGAKIVYNTNNEDSLEMGRKAYAELGIDAKGYLCDVTDEEAVQAMVADIEKTVGTIDILVNNAGIIKRIPMTEMRASEFRQVVDIDLVGPFICSKAVIPSMIKKGGGKIINICSMMSELGRETVSAYAAAKGGLKMLTRNIASEYGEYNIQCNGIGPGYIATPQTAPLRERQPDGSRHPFDSFIIAKTPAARWGTPEDLMGPALFLASKASDFVNGHVLYVDGGILAYIGKQP

SEQ ID NO: 367 - protein, 250 aa, Artificial Sequence
  Synthetic
MKTALVTGGSRGIGLAIALELGRSGYAVAIMATKPESAYPQSTQKLREAGVSYSWHAGDIANSEDRLRVVNEVTARHGRIDVLVNNAGVAPKERNDLLQMTEESFDYVVGTNTKGNMFMTQAVARQMIQARTPGIIVNISSCSAEVSSVNRGEYCVSKAGISMLTRLFADRLAGEGIRVYEVRPGVIQTDMTAAVQEKYNRLIEAGAFPIARWGQPEDVARAVRAFCSDDFAYTTGNYVDVDGGFHIRRL

SEQ ID NO: 368 - protein, 244 aa, Artificial Sequence
  Synthetic
MATAIITGSARGIGAAIALRLAKDGYDIALNDIAESCFENNDIIDKIKAEGVKCEKYIADVSKYDQCEAFVKSVKADFGSIDVLVNNAGITRDGLLVRMSEENYDLVVAVNQKSVFNMTKFAGSVMMKQRSGRIINLASVAGLYGNPGQMNYSATKAAIIGMTKTTAKELGPRNITCNAVAPGFIHTAMTDALSEELRAAMVKQIAMGRCGEVEEIAGVVSFLASKDASYVTGQVIEISGGLSM

SEQ ID NO: 369 - protein, 288 aa, Artificial Sequence
  Synthetic
MGFKRVIRKAAKLVLASSPEKFVNVEVAQVSAGSVLKGKTVVITGGGRGLGLAMAEKFISEGAKVVISGRKEATLKAACEKLGSGVSYVVADVSEAERAGEFLDACEVKLGGRIDCLVSNAGLSLHENRFDNVTIEGFDKQFAINMRGAYFLCREFLCRKEREKEPSGELLVITSETGEQAYDIPYGMTKAGMDSFVRAASRRMYPLGVRVNAVAPGVTLSDMTRDYAEASDGNMYRECASGRIFRPEEVAEVACFLLSDASKCVSGEVIHTNGGNHIKAFWDVSCDG

SEQ ID NO: 370 - protein, 263 aa, Artificial Sequence
  Synthetic
MGKLTGKTALITGASQGIGEGIARTFARHGANLILLDISDEIEKLADELAGRGHRCTAVHADVRDFASVTEAVKRAKKVEGKIDILVNNAGVCRLGNFLEMSDDDRDFHIDINIKGVWNVTKAVLPEMIDRKDGRIVMMSSVTGDMVADPGETAYAMSKAAIIGLTKSLAVEYAQSGIRVNAICPGYVRTPMAENIARQSNPGDPESVLTEMAKAIPMRRLACPLEVGELAAFLASDESSYLTGTQNVIDGGSTLPESVSVGV

SEQ ID NO: 371 - protein, 250 aa, Artificial Sequence
  Synthetic
MKLYLENKTALVTGAGSGIGREIARALAEEGVNVMIVGRTEKNLQETASLHERISYKIADITKTREIENILSEIVNKWGKLDILINNAGWSPIHPFEEETMEEFDKAFNINVRAVAELVLKTLPLLKESKGNIVNISSTAIRNHLVNMSVYTAAKGAVDMFTKIWAKEFAPYGIRVNSVSPGPIETPIYDKLGVDGQEKTEHLARVTAGIPLGRFGRPEEVAPAVLFLVSDLVAGYVTGSDYCVDGGYGD

SEQ ID NO: 372 - protein, 244 aa, Artificial Sequence
  Synthetic
MSFEGKIALVTGASRGIGRAIAETLAARGAKVIGTATSESGAQAISDYLGAYGKGLMLNVTDAASIESVLENIRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALSDDQRAGILAEVPAGRLGDAKEIASAVAFLASDEAGYITGETLHVNGGMYMV

SEQ ID NO: 373 - protein, 288 aa, Artificial Sequence
  Synthetic
MAFLSKKIVRSEYENMVVAGCSSGFGKNLAETLLSEGEQVVATARNPETIQHFDEKYPQTALCVRLDVTKKDTIDSAVKEAIEKFGKIDVLINNAGYCLRGAVEECTEEEIYAEFNTNFFGAVRMIQAVLPHMRKAGSGAIINYSSIAALDTSAGSAFYGAAKCALEGLSCGLRKEIEPLGIKVLVVEPSPFKTDFFDRSIDINPNRISAYDNTANKRKVKISDLSKVDMKWCDMGRACKLITDIIQRPDAPHHILLGSMAVGIGEKFVKDRAEEIQKWKEASESLDA

SEQ ID NO: 374 - protein, 262 aa, Artificial Sequence
  Synthetic
MDRKEEQNQERNRQKEIFAGKVAVVTGASRGIGRAIALELARKGAMVVINYNGSEERAREVQKCIEEEGNEAAIMQCDVSDFQACEVFFKKVIEQFGRLDILVNNAGITKDGLLMKLSEDDFDSVVDTNLKGSFHCMRFASRQMIRQRSGRIINLSSVSGVMGNAGQTNYSASKAGVIGLTKAAARELAAKNITVNAIAPGFIATDMTEKLSDRVRETVVTQIPMGHFGTVEDIAHAAVFLATEEAAYITGQVLCVDGGMAM

SEQ ID NO: 375 - protein, 250 aa, Artificial Sequence
  Synthetic
MPNRIQNQKNALVTGAARGIGRAIALSLAKEGYNVAVLYLGSEEAAEQTCDEIRQLGRQALCIRCDVACGESCRQAVAQVIEEFGSIDVLVNNAGIVRDSLVLSMKEEDFEQVVQTNLNGAFYMIKHTCRQFIKNRHGRIINISSVTGVMGNAGQANYASAKAGLIGLTKSVARELAGRNITCNAVAPGFVATDMTAAMPQKILESAVAQVPLGRMGTAEEIAQTVAFLCSDAAGYITGQVLCVDGGLSM

SEQ ID NO: 376 - protein, 244 aa, Artificial Sequence
  Synthetic
MSKVAVITGASGGIGAAVARRLAAQGCYVVLGYCRSREKAESLCRELREAGGEAVSFRADLTKAEEAKALIDFAVQQYGHLDILVNNAGISQIKLFTDITPEDWQRMFAANVDGIYHCCRAAVPYLVQQHSGTIINVSSIWGLCGASCEVHYSASKAAVIGFTQALAKELAPSGITVNCVAPGAIDTEMNAHLTAEERRMLEEEIPLGRMGSPEEVAAAIAFLAGEDARYFTGQVLSPNGGIVI

SEQ ID NO: 377 - protein, 288 aa, Artificial Sequence
  Synthetic
LVKTKHSVILFIFVGNTSYMQPQVILITGASSGFGKITAQMLSEQGHIVYGTSRKLSEDMNEVKMLVVDVTNSLSIRQAVDRILSEQGRIDVLINNAGMGIGGALELATEEEVNIQMNTNFFGVVNMCREVLPVMRKNRKGKIINISSIGGVMGIPYQGFYSASKFAVEGYSEALALEVHPFNIKVCVVEPGDFNTGFTDNRNISEQTRLDADYGESFRKSLEIIEKEERNGCHPRKLAAAICKIVERTNPPFRTKVGLWIQVLFAKSKKWLPDAVMQYALRIFYAIK

SEQ ID NO: 378 - protein, 262 aa, Artificial Sequence
  Synthetic
MNLENKVVVVTGGSAGLGEQICYEAAKRGAIVVTCARRTNLIGKVKEQCMELSGKEAYAFQLDVANPESVERLLEKINEKVGKIDVFVNNAGYGIFQEFTEMDPAVIRNMFEVNVLGMMVLTQQVAIQMAEQKHGHIINVASIAGKIATPKTAVYSATKFAVLGFSNALRLELKPLGINVTTVNPGPIETAFFDQADPSGSYLSSVGSLVLEPNKLAQTIVKAMIHPKREINRPHILGAAAKLYTLFPSIGDYMAGTMFNKK

SEQ ID NO: 379 - protein, 250 aa, Artificial Sequence
  Synthetic
MSETILVTGASAGFGQAICRRLVEDGYRVIGSARRIEKLQALHEELGEAFYPLQMDVTDLSQVDHALASLPADWDQIDVLVNNAGLALGLAPAYEAEVSDWLTMIQTNIVGLTYLTRQILPQMVQRNDGYIINLGSTAGTVPYPGANIYGASKAFVKQFSLNLRADLAGKKIRVSNIEPGLCEGTEFSSVRFKGDEKRVEALYKDAHAIQPEDIANTVAWLLKQPKHVNVNRIEIMPVSQSFGPQPIYRD

SEQ ID NO: 380 - protein, 244 aa, Artificial Sequence
  Synthetic
MEQKTAIVIGASTGIGAATAEALAQQYKKIAITSFRHPEKLKEVQQKILAQGTDCYAEIGDAGDFTFVRQFIEHVIEHFGKKIDLLVNNAGISYVGLLTDMDETDWKRIIDTNITSVFNTCRQVVPYMVHAHKGRIINISSVWGNVGASCEVAYSATKGAVNAFTKALAKELAPSGIAVNAIAFGAIDTTMNGHLSSEEKNALEEEIPFGRMGTETEAAEFIITVANAGSYLTGQILTFDGGWQ

SEQ ID NO: 381 - protein, 288 aa, Artificial Sequence
  Synthetic
MGFKRVIRKAAKLVLASSPEKFVNVEVAQVSAGNVLKGKTVVITGGGRGLGLAMAEKFISEGAKVVISGRKEATLKAACEKLGSCVTYVVADVSEAERAGEFLDACEAKLGGRIDCLVSNAGVSLHENRFDNVTIEGFDKQFAINMRGAYFLCREFLCRKGREKEPSGELLVITSETGEQAYDIPYGMTKAAMDSFVRAASRRMYPLGVRVNAVAPGVTLSDMTRDYAEASDGNMYRECASGRIFRPEEVAEVACFLLSDASKCVSGEVIHTNGGNHIKAFWDVSCDG

SEQ ID NO: 382 - protein, 262 aa, Artificial Sequence
  Synthetic
MCNENRLKGKLALITGATSGIGKSCAEKLAGMGVNLILTGRRTEILNEVKAEIEKKYGVKVLTMQLDARNYKEVVEKITALEGEWKNIDILINNAGLALGMEKVYSNSAEDIDAVIDTNVKGMLYMIREVVPGMVERDKPALVVNIGSVAGDAAYAGGAVYCASKAAVKTLSDGLRIDLVDTKVKVTNIKPGLVETNFSVIRFKGDKDKADKVYKGIEALTPDDIADTVMYICNLPDNVQIPEIIMTPMFQADGRNVYKQSK

SEQ ID NO: 383 - protein, 250 aa, Artificial Sequence
  Synthetic
MKKVAFITGASSGFGDACVKAFINEDFKVIALARRKERLDKLKELYKEQIYTLNLDVRKKKELFEAVATLPSEFQNISVLFNNAGLALGLEEFDKLSLDDIDAMVDTNVKGFLYVARAVIPLLRRQENAYIFNLGSIAENVAYFGGNVYCGTKAFVGQFSRALRNDLRGTNIKVTNIAPGLCKTEFSEVRFRGDKAQANAVYEDTKFITAEDIARVVMSIIHLPPHINVNKIELMPVTQSWAGSFVEKVR

SEQ ID NO: 384 - protein, 244 aa, Artificial Sequence
  Synthetic
MEKLLVGKTAIVTGAARGIGKAVALKFAREGADVVMLDILEKELKESKAEVEAFGTKVEAIAADLTVEGLVMDTVDTVVRKFGTVDILMNCAGISREMPLNEMSMETFDKIMEVNLRSVVLMIKAVLPIMIQNKCGNICSIASGAALRGLPGSSAYSASKAALLCLSQALGDEQRPNGIRVNVICPGPVDTEMFQKSAAREFILKAGGDLFSPDTVANGALFLVSELSRGVSSQVLTMRGFNRW

SEQ ID NO: 385 - protein, 288 aa, Artificial Sequence
  Synthetic
MGFKRVIRKAAKLVLASSPEKFVNVEVAQVSAGNVLKGKTVVITGGGRGLGLAMAEKFISEGAKVVISGRKEATLKAACEKLGSCVTYVVADVSEAECAGEFLDACEAKLGGRIDCLVSNAGVSLHENRFDNVTIEGFDRQFDINMRGAYFLCREFLCRKEHEKDPSGELLVITSETGEQAYDIPYGMTKAAMDSFVRAASRRMYPLGVRVNAVAPGVTLSDMTRDYAEASDGNMYRECASGRIFRPEEVAEVACFLLSDASKCVSGEVIHTNGGNHIKAFWDVSCDG

SEQ ID NO: 386 - protein, 262 aa, Artificial Sequence
  Synthetic
MNLEDKVVLVTGSSGGLGAQICYEAAKQGAIVISCARRMAFVEGVRDECRRLSGKEAYAFKVDVSDPYSVDELYEKVMEEVGRVDILVNNAGFGIFEDFLTFDLGKAYDMFEVNILGMMVLTQKFAIDMAERRQGHIINIASMAGKMATAKSTVYSATKFAVLGFSNALRLELKPLGVAVTTVNPGPIETDFFDKADPSGSYLEKVGQIVLEPTKLAKMIVRNMRHPKREINQPFILEVASKFYTLFPTIGDYLASGIFNKK

SEQ ID NO: 387 - protein, 250 aa, Artificial Sequence
  Synthetic
MSTLDPTTPTALVTGGSRGIGRAVALTLARDGHQVILTYVSRPEEADKTVAEIEAAGGRALALPLNVGDGEAVAAFFAEHIKGKVNLAVLVNNAGITKDGFLVRMKDDDFDRVITINLRGAFICTREAAKIMTKARHGRIVNISSVVGQMGNAGQANYSAAKAGLLGLTKSCAKELAARQITVNAVAPGFIETDMTAALSDEVRASYEAAIPLKRMGTAQEIADAVAFLASDRAAYITGQVLAVNGGMYC

SEQ ID NO: 388 - protein, 244 aa, Artificial Sequence
  Synthetic
MELKNKNVFVTGSTRGIGLAVAHQFASLGANVVLNGRSEISEDLLAQFVDYGVTVVGISGDISNGEDAKRMVAEAIEKLGSVDVLVNNAGITNDKLMLKMTEEDFERVLKINLTGAFNMTQAVLKPMSKARQGAIINMSSVVGLMGNVGQANYSASKAGLIGFTKSVAREVAARGVRVNAIAPGFIESDMTDAIPEKMKDAMIAQVPMKRIGQAKEVAEVAAFLAGQEYLTGQTIAIDGGMTMQ

SEQ ID NO: 389 - protein, 288 aa, Artificial Sequence
  Synthetic
MGFKRVIRKAAKLVLASSPEKFVNVEVAQVSAGSVLKGKTVVITGGGRGLGLAMADKFVSEGAKVVISGRKEATLMTACEKLGSGVSYVVADVSEAERAGEFLDACEAKLGGRIDCLVSNAGVSLHENRFDNVTIEGFDKQFGINMRGAYFLCREFLCRKEREKEPSGELLVITSETGEQAYDIPYGMTKAAMDSFVRAASRRMYPLGVRVNAVAPGVTLSDMTRDYAEASDGNMYRKCASGRIFRPEEVAEVACFLLSDASKCVSGEVIHTNGGNHIKAFWDVSCDG

SEQ ID NO: 390 - protein, 262 aa, Artificial Sequence
  Synthetic
MCNENRLKGKLALITGATSGIGKSCAEKLAGMGVDLILTGRRTEVLNEVKNEIEKKYGVKVLPIQLDARNYNEVSEKIAALEGEWKNIDILVNNAGLALGMEKVYSNSAEDIDAVIDTNVKGMLYMIREVVPGMIERDKPALVINMGSVAGDAAYAGGAVYCASKAAVKTLSDGLRIDLVDTKVKVTNIKPGLVETNFSVIRFKGDKDKAEKVYKGIEALTPDDIADTVTYICNLPDNVQIPEIVMTPMFQADGRCSYKKDK

SEQ ID NO: 391 - protein, 250 aa, Artificial Sequence
  Synthetic
MAFDFTGKTVWVTGAGKGIGYATALAFVEAGAQVTGFDLAFPHGEYPFATETLDVADAAQASDVCGRLLSSLERLDVLVNAAGILRMGATDQLSQEDWQQTFAVNVGGAFNLFQQTMGQFRRQQEGAIVTVASDAAHTPRIGMSAYGASKAALKSLALTVGLELAGSGVRCNLVSPGSTDTDMQRTLWTSDDAEQRRIRGFGEQFKLGIPLGKIARPQEIAATVLFLASDAASHITLQDIVVDGGSTLGA

SEQ ID NO: 392 - protein, 244 aa, Artificial Sequence
  Synthetic
MSFEGKIALVTGASRGIGRAIAETLVARGAKVIGTATSESGAQAISDYLGANGKGMLLNVTDPASIESVLGNIRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALTDEQRAGTLAAVPAGRLGSPNEIASAVAFLASDEASYITGETLHVNGGMYMV

SEQ ID NO: 393 - protein, 288 aa, Artificial Sequence
  Synthetic
MGIKKVVKKLLPKELKEALKKEIGSNTSYVLNISDVKKLENKIAVVTGGSGAIGSALCFRLAMEGATVGVGARSLNKAEIVINNIKKNGGNAFPVLMDLIDDKSIDVAFEKIYAEYGPMDILVNNAGGSARNAAKNFEEQDFSVIDTVLNINLRGTMYCTYAALKHMKRENTSRIINMSSIVGLQGKRGMTDYAASKAGLLGFTRSLALELGKTGITVNSVSPGWVSRAVFDKGMEVQQGNVNCMGHSGKTDDVAGAVAFLVSEEANYITGQNIIIDGGRSLGLWGDN

SEQ ID NO: 394 - protein, 262 aa, Artificial Sequence
  Synthetic
MGKLSGKTALITGASKGIGEGIARTFVKHGANVVLAARGQAVEELAAQLRAEGAQAVAVRMDVADMDSVRAGYEAGVKAFGAIDILVSNAGICRLGDFLTQSDADRDAHLDINVKGAWNTCKAVLPAMVERKWGKIVIMSSVTGDMVADPGEAAYAMSKAALVGLTKALAREFAPYVNVNAICPGYVLTPMVQGMAVQSCPDNPQSVVDGIASAIPLGRLADPKEVGELAAFLASDEASYLTGAQFVIDGGSTLPETSTMGV

SEQ ID NO: 395 - protein, 250 aa, Artificial Sequence
  Synthetic
MKALITGASSGIGRDIAKELSKRGYDLVLVARDLEKLNKVKSEIKNTNIEIVGLDISTVENCKELYKNYKDIDILVNNAGFGDCGYFISTNLEKEVQMINTNIVAYHVLTKLYLKNMQEKNKGKILNVASIAGFMPGPLMATYYSTKAYVVRLSESIREELRKEKSKVQISILCPGPVDTNFNKVANVEFALKGLSSQYVAKYAIQKFLKGKFYIVPGIKIKLAKFASKMFPSNLVAKVSYNMQRKKIKK

SEQ ID NO: 396 - protein, 244 aa, Artificial Sequence
  Synthetic
MERRVVVITGASNGIGEGIVRYLSKYDYNIVLNYNTSKDKALKIQNEIFEKFGKQIEIFKADISKRKEVKELVGFCIEKFKRIDVLINNAGISQIKPFTDITDEDWNNIIQVNLTSAFYTSQECLRYMIKEKNGCIINISSIWGKTGASCEVHYSVSKAGLDGLTKSLAKELGPSNIRVNGIAPGIIDTRMNNDLTKEDIESIKEEIPLEKIGNVVDIAKCVKWLIEDEYTTGQIIGINGGWNI

SEQ ID NO: 397 - protein, 288 aa, Artificial Sequence
  Synthetic
MTDLKQKKGEAESGSEFFRTFVRIFYPDEELIVTSNTFTTMKLLEGKVAVVTGAARGIGKAIALQFAKEGANVAFTDLVIDENGKATEAEIAALGVKAKGYASNAADFEQTHKVVEEIVKEFGRIDILVNNAGITKDGLMMRMSEAQWDAVLTVNLKSAFNFIHAVVPVMARQKSGSIINMSSVVGVSGNAGQCNYSASKAGMIGLAKSIAKEMGPRGIRANCIAPGFIITDMTNQLSDEVREAWCKQIPLRRGGTPEDVAKVALFLASDLSSYVSGQVIHCCGAMNC

SEQ ID NO: 398 - protein, 262 aa, Artificial Sequence
  Synthetic
MEKRRVAIVTGGTRGMGQAVSVELARKGNIVCAIYRSHEESAKETLAKMQKFVPECCVYKADVSKEEEVQRTVREIGDKFGRIDILVNNAGIFDFRFIDEMDSAYLDRVIDTNFKSQFYMLQNAAEYMKKNNYGRIANASSISGHFADCGLVAYAASKAGVDMLTKISAAELGPYNISVNAYAPGIIHTDMTDAMIQERGDEQVRDLCLNRFGTGEDVAALVGFLTSPEGGYVTGEIIGIDGGMFKVQNTYLAYEHAKRQGN

SEQ ID NO: 399 - protein, 250 aa, Artificial Sequence
  Synthetic
MKGYGCEGLHVVISGGTSGIGLAAAEKMLVDGAASVCILGRSQARGEAAVKFLLEKTGKEALYLPCDVSRQEDCVKAFKQLGVQQDILIASAGIYVEERLEQISEQSFALLDTNVKGTVYFLQAGLPYLREGGSIVTVASDAGVSGNYGCPLYCASKGAVVALTRALALDLAPAVRVNCVCPADVDTPLLQKQLEQCGGSYGIEDMSSVYPMQRIAQAEEIAHVICSVASPLNSFMTGSIITVDGGLTAK

SEQ ID NO: 400 - protein, 244 aa, Artificial Sequence
  Synthetic
MNKNVLITGGTRGIGEAISREFAKKGYNLIINYINSKEKAEKLKTELETEFNISVLTIQGDLSEEKAIENMVDIAMDKFGKVDVLVNNAGIVIDKEFEDRTIEDWKQTLNINLIAPFILTKLIGKEMVKNKGGAIINISSTNGINTYYPTSVDYDASKSGLISLTYDSAVELAPYVRVNCIAPGWVNTEMNKELPEDFVKEETERILVKRFAEPEEIAKVATFLASDDASFINSTIIKVDGGWY

SEQ ID NO: 401 - protein, 287 aa, Artificial Sequence
  Synthetic
MGNKIILVTGASDGIGKETAKALAKQGHTILMHGRSLQKTKSAYEEIKAESGNDKITYLTADFLSLAEVRQFADKIKQKYDRLDVLVNNAGAQFTGKRETTLERHEKTMTINLFAPHLLTMLLLPLLKKSSSARVVTVASAAHKMAGKPDLNDIELNNNYSMGKAYGLSKLYVIWIMRHFVSEMKRAGVNNITFNTVHPASATSSLGRESTKSLSTKIIYFLWKPLMKTAAQGAASSIYAAISSELEGVTGKYYGLKGEEKPSEKYYSPENEQIVWNYSINIIKPYL

SEQ ID NO: 402 - protein, 262 aa, Artificial Sequence
  Synthetic
MGKLTGKTALITGASKGIGEGIARTFAKHGANLVLAARGSETQALAQSLCENGTKAIAVTMDVSDMASVQAGYEAAVQAFGGVDILVSNAGICRLGDFLTQSDADRDAHLDINVKGAWNTCKAVLPGMVARKWGRVVIMSSVTGDMVADPGEAAYAMSKAALVGLTKALAREFAPYVNVNAICPGYVLTPMVQGMARQSCPENPQSVVDGIAAAIPLGRLADPMEVGELAAFLASDEASYLTGAQFVIDGGSTLPETSTMGV

SEQ ID NO: 403 - protein, 250 aa, Artificial Sequence
  Synthetic
MGLLTGKTALITGAARGIGKAIALKYAQEGANVAFTDLFIDEEHGGLETEREIQALGVKAKGYASNAANFDESAEVVAKVKEEFGAVDILVNNAGITKDGLMLRMTEQQWDAVIAVNLKSAFNFIHACVPVMMRQRGGSIINMASVVGVHGNAGQANYAASKAGLIALAKSVAQEMGPKGIRANAIAPGFIDTAMTQALPDEVRKEWASKIPLRRGGTVDDIANTAVYLASDLSSYVSGQVLQVDGGMNM

SEQ ID NO: 404 - protein, 244 aa, Artificial Sequence
  Synthetic
MSFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 405 - protein, 287 aa, Artificial Sequence
  Synthetic
VIKKIGKAFLRIEHACSAFLHVLKAGGINTIKVSQVQKDDVLSGKNIVITGGSSGIGLAIAKKSIEAGAKVVITGRNEEKLKQTVSDLGSQHAGYVLWDITDSAQADDKVAQCVDYFGGRVDAVVNNAGIQPHEFFPNVSVAEWNRVYETNSQGTFFVSQAFCKYWMQASSGCYRHLINISSQGGFVGATYPYRMSKWDIRGLTAGLGFQMAPYGVLVNGVAPGVVKTSMQSFALEQGNNTYCKQNPLERVALPEEIAEFIVFMLSDACNFMVGQTVVLDGGYSLKN

SEQ ID NO: 406 - protein, 262 aa, Artificial Sequence
  Synthetic
MFCENRLQGKLALITGATSGIGRSCAEKLAQMGVNLIITGRRANILDEIKKELEEKFNIKVCPLQLDARSSKDVDEKIDNLPNEWKNIDVLINNAGLALGLDKVYNNSVEDIDAMIDTNVKGMLYMIRKIVPSMVARDLPALVVNIGSVAGDAAYAGGAVYCASKAAVKSLSDGLRIDLVDTKVKVTNIKPGLVETNFSVIRFKGDEEKAGNVYKGIEALTPDDIADTVVYICNLPDNVQIPEITMTPMFQASGTVLHRSNN

SEQ ID NO: 407 - protein, 250 aa, Artificial Sequence
  Synthetic
MPFSDYKVALVTGASAGMGEAIVERLCREGITVHAVARRREQLATLAERTGCIPHAVDVANLDALTRLCSDLQVDILVNNAGVSHPGSILNASEEVIETQLNVNLRAVLHLCRLLVPGMMARDRGHVINITSIAAIYNFNGNSVYHATKAGVHALSRQLRVDCYGKRVRITEICPGRVATDIFGNVSGDHEDARKRFIDGFELPEAKDIADCVAFAVSAPIAVNIGNIEITPTLQVPGGLSTMRPGESAV

SEQ ID NO: 408 - protein, 244 aa, Artificial Sequence
  Synthetic
MEQKTAIVIGASTGIGAATAEALAQQYKKIAITSFRHPEKLKEVQQKILAQGTDCYAETGDAGDFTFVKQFIEHVTEHFGEKIDLLVNNAGISYVGLLTDMDETDWKRIIDTNITSVFNTCRQVLPYMVHAHKGRIINISSVWGNVGASCEVAYSATKGAVNAFTKALAKELAPSGIAVNAIAFGAIDTTMNGHLSLEEKTALEEEIPFGRMATEKEAADFIVTAANAGSYLTGQVLTFDGGWQ

SEQ ID NO: 409 - protein, 286 aa, Artificial Sequence
  Synthetic
LLQLTKLALDLSLHFKYSKSDLNFRKDKSKTKELFMLLEGKTALVTGASQGIGKEIARILNKNGAKIYIMARSADKLSTTAKELDPTGKEVFAVPCDITSNTAVEEVFKRFKADGISIDILVNAAGTANSNSIETTDIELWDKVLDTNLTAAFNLSQKCFLMMKEKGYGKIINLASILANVTSPGMAAYSASKAAVKMLTKTQAVEWAKYNIQSNAIAPGYIKTDMTKGILNNKELTQKLVGRTPMGRIGEPEDVAKVALFLASPLSDFVTGTEIPVDGGILAALM

SEQ ID NO: 410 - protein, 262 aa, Artificial Sequence
  Synthetic
MNLENKVVLVTGSSGGLGAQICYEAAKKGAIVIACARRSQLIDEVKAECQRLSGKEAYAFPVDVSDPDSVDRLYEQVMQTVGRVDVLVNNAGFGIFEDFLTFDLGKAYDMFEVNVLGMMVLTQKFAIDMAERRQGHIINIASMAGKMATAKSTIYSATKFAVLGFSNALRLELRPLGVAVTTVNPGPVATEFFDKADPTGSYLEKVSQLVLEPEKLAKTIVRTMEHPKREVNRPVLLEIAAKFYTLFPTIGDYLASGIFNKK

SEQ ID NO: 411 - protein, 250 aa, Artificial Sequence
  Synthetic
MSETILVTGASAGFGQAICRRLVADGYRVIGSARRIEKLQALQEELGEAFYPLQMDVMEPSQVDHALASLPKAWERIDVLVNNAGLALGLAPAHEAEIVDWLTMIQTNIIGLTYLTRQILPQMVERNDGYVINMGSTAGTVPYPGANVYGASKAFVKQFSLNLRADLAGKQIRVTNIEPGLCEGTEFSTVRFKGDEKRVEALYRDAHAIQPEDIANTVSWLIQQPKHVNVNRIEIMPVSQTFGPQPVYRD

SEQ ID NO: 412 - protein, 244 aa, Artificial Sequence
  Synthetic
MNTAKTAIVTGASHGIGQMTALKLAAAGYDLAICCQKDMTALSAVAKQITANGRNCLAMQCDVGDSAQVADFFSQIQITYPHIDLLINNAGISYVGLLQDMSDDEWTAIVNSNLSSVFYSCRAVIPTMLAQQYGKIINITSVWGEIGASTEVAYSATKGGVCAFTKALAKELGPSHITVNAVSCGFIDTRMNGQLSDDERSSLFEEIPVGRPASAEETADFIVQVAQSGEYLTGQVLRFDGGWI

SEQ ID NO: 413 - protein, 286 aa, Artificial Sequence
  Synthetic
MFQVLAECILRGVASSGSLTEKSATEFCSGDQPALSLWKNPKSMKRRVFVTGGAHGIGKGIVEAFARQGDEVVFCDLDPVLGTQTAAETGAQFCQLDVTDAVSLERCMRELFDTWGDIDILVNNVGISPFKPLTELSIEEFDRVIATNLRPVFITSRQLVLHRQQNGNRSYGRIINLCSTRYLQSEAGTEAYSASKGGIYSLTHSLAVSLAPFHITVNAIAPGWIHVREEEQLRPEDHAFHPSGRVGTPEDIARACLFLCDEANDFLNGQTLTIDGGATIRMIYPE

SEQ ID NO: 414 - protein, 262 aa, Artificial Sequence
  Synthetic
MDLTNKVVVVTGGSAGLGEQICYEAAKQGAVVVVCARRINLIGKVREQCAALSGREAFSYQLDIADPESVERVVEAISAEVGPIDVLVNNAGFGLFENFVEIDLAVARQMFDVNVLGMMTFTQKVAIKMIEAGQGHIINVASMAGKMATAKSTVYSATKFAVLGFSNALRLELKPLGVAVTTVNPGPIQTEFFDKADPTGTYLAAVDKIVLDPTKLAKEVVGSMGTSRREINRPFVMEAAARFYTLFPHLGDFIAGNILNKK

SEQ ID NO: 415 - protein, 250 aa, Artificial Sequence
  Synthetic
MPFSDYKVALVTGASAGMGEAIVERLCQEGIEVHAVARRHEQLAALADRTGCIPHAVDVGDLSALTALCQGLQVDILVNNAGVSHPGSILDAEADWVNTQVDVNLRAVLHLCRLLVPGMVARDCGHVINITSIAAIYNFNGNSIYHATKAGVHALSRQLRVDCYGKRVRITEICPGRVATEIFGNVSGDHEDARRRFIDGFELPEAKDIADCVAFALAAPVAVNIGNIEITPTLQVPGGLSTMRPGDRES

SEQ ID NO: 416 - protein, 244 aa, Artificial Sequence
  Synthetic
MGKIAVVTGASKGIGRACALRLAKDGMTVVVNYSHSDAEAAKTVEEIKAAGGDAVAYKADVSDLNQVKDMFKFVSDTYGRVDILVNNAGIVRDEYLLMLTQENLDKCLDLNIKGYFYCAQQAALKMFSQKSGVIVNMSSVSSKMALAGQSVYSATKGAVNSMTQTMAKELARKKIRVNAVCPGFVQTEMVDQLPEDKKKEYLKEVPLGRFADVDEVAGLVSFLCSDDASYITGQAIVLDGGLSL

SEQ ID NO: 417 - protein, 286 aa, Artificial Sequence
  Synthetic
MDLSAFDLKGKVALITGGAHGIGFSIAEGMAKCGAAICFNCSSEASLEKGMAAYKAAGIEAHGYVADVSDEDAVNAMVAKIKAEVGPVDILVNNAGLMKRVPMVEMSHADFMRVIDVHVGGAFNCSKAVLPDMMEKHEGKIINICSMMSELGRETVSAYAAAKGALKMLTKNIASEYGEYNIQCNGIGPGYIATPQTAPLRERQPDGSRHPFDSFIVAKTPAGRWGEAEDLGGPAVFLASAASDFVNGLILYVDGLTSASSRSNFQYANCTRSAPFGGALRVLFLF

SEQ ID NO: 418 - protein, 262 aa, Artificial Sequence
  Synthetic
MEDRLEYGRKKTIVVTGADRGLGLALVAEYLKGGNRVFAGKYRRNWHQLEELKEKYPGSLEIIELDVRSQESVEKAACAILEKTEAIDILINNAGVWLDHNTGTILDEEMDYDAIMEQINVNALGALRVTHALIHAVLKSFDQLVVNISSEAASMTDCKKDSQFGYCMSKAALNMASCLILNGIREKGGAVINLHPGWMQSVIGEPADCDAPYVEPAEPGEVKYYTTPEITARGFIRILEEPERFSGRLPGFVNYRGDKMNW

SEQ ID NO: 419 - protein, 250 aa, Artificial Sequence
  Synthetic
MSNNIENKVVLITGASSGIGQATAELLAKKGAKIVLAARRENRLQELADKIKKAGGQAIYQVTDVTNPEDSKKLVQYAKENFGKIDAIFLNAGIMPSSPLSALHVEEWENMVDINLKGVLNGLAAVLPEFTAQKSGHVITTSSVAGLKAYPNGGVYGATKWAVRELMEVLRKESAQEGTHIRTATIYPAAINTELLNTITDKDAAEGMTALYEQYGISPEAIARIVAFALEQPEDVNVSEFTVGPTTQPW

SEQ ID NO: 420 - protein, 244 aa, Artificial Sequence
  Synthetic
MSFEGKIALVTGASRGIGRAIAETLVARGAKVIGTATSESGAQAISDYLGANGKGLMLNVTDPASIESVLENVRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALTDEQRAGTLAAVPAGRLGTPNEIASAVAFLASDEASYITGETLHVNGGMYMV

SEQ ID NO: 421 - protein, 286 aa, Artificial Sequence
  Synthetic
LLQLTKLALDLSLHFKYSKSDLNFRKDKNKTKELFMLLEGKTALVTGASQGIGKEIARILNKNGAKIYIVARSADKLSTTAKELDPTGKEVFAVPCDITSNTAVEEVFKRFKADGISIDILVNAAGTANSNSIETTDIELWDKVLDTNLTAAFNLSQKCFPMMKENGGGKIINLASILADVTSPGMAAYSASKGAIKMLTKTQSVEWAKYNIQSNAIAPGYIKTDMTKGILNNKELTQKLVGRTPMGRIGEPEDVAKVALFLASPLSDFVTGTEIPVDGGILAALM

SEQ ID NO: 422 - protein, 262 aa, Artificial Sequence
  Synthetic
MAKRRLGHTPLALVTGGSSGMGLEYCRTLAGAGCNLLIVSIEEEKLQSISQEITDEFGVRATGVFMDLSRPDAADRLHSYCRDHGYEVDILINDAGVFFFKELGCGDIDRMEMMINLHTLTPAKLCVLFGEDMKKRGCGYILNMSSVAANLPFPGVTTYSATKAFLKSFGKSLYYEMKPYGVRVCTVCPGAVATPLYRLKPSLLRLGVWLGIIKKPSTIVRRGLKGMYRGRRVVNPSLMSYYLPPMLGILPKPLISAIWKKL

SEQ ID NO: 423 - protein, 250 aa, Artificial Sequence
  Synthetic
MGWDFTGKTVWVTGAGKGIGYATALAFAEAGAQVTGFDLAFPQDHYPFATETLDVADAAQVHEVCGRVLASLERLDVLVNAAGILRMGATDQLSQKDWQDTFAVNVGGAFNLFQQTMGQFRRQQGGAIVTVASDAAHTPRIGMSAYGASKAALKSLALTVGLELAGSGVRCNLVSPGSTDTDMQRTLWKSDDAEQQRIRGFGEHFKLGIPLGKIARPQEIASTVLFLASDAASHITLQDIVVDGGSTLGA

SEQ ID NO: 424 - protein, 244 aa, Artificial Sequence
  Synthetic
MRAVITGATGGIGGATAEALGRAGYEVIITGIDLEAGKKVIDKLESQGIKVHFYACDATNEEQVNETFAKIGEEFGSLDLLVNNVGGLGGRQRVSEMETGFMRKVMALNFDSVFFNTRAALPLLKKGKDASIVNFSTIAVTSGAGIGASIYAASKGAVQSYTRALAKDLAEFGIRANMVSPGTIDTAFHAATDRALVESWKDSILMKRLGDPREVADVIVFLASEKASFITGEVIQINGGQAFI

SEQ ID NO: 425 - protein, 285 aa, Artificial Sequence; identical to SEQ ID NO: 13
  Synthetic

SEQ ID NO: 426 - protein, 262 aa, Artificial Sequence
  Synthetic
VLNLKGYELKMENVLITGATSGIGYEITKIFAQNQHDLLLCARDKKKLIEIREKLINEYKVKVFIFSKDLSKEKDVEELYREIMELGINVDILINNAGAGYVGEFINESYDRDKSIMSLNMNAVTYLTKVFANEMIKINKGKILNVASTGSYHPGPYTAVYYATKAYVLSFTEALAEEMKEYNITVSALCPGATKTNFSKKAGKKDNATAMSPEYVAQKAYEGLIKNNTTIIPGFKYKIFVLLPRKIITPFIGRYQRKLKNN

SEQ ID NO: 427 - protein, 250 aa, Artificial Sequence
  Synthetic
MSYFEGKTVLVTGAATGVGEGVAQRLYQAGATVFISGRQLEQVKKTAYTIDPTGEKVIALQADMTSPEQVKSMFETILAQTGALHGLVNNAGITGPHNTSIVDYNIDDWKAVMDTDINGVFYGLKYGIPALLRSGGGSIVNLSSTNGIVGIAGISAYTAAKHAVLGITRSAALEFAQQGIRVNAIGPGYVDTPRMQQLPNEVRQWMASTHPMKRMATRKEVANMVAFLLSDESSFSTGAFYAVDGGYTAQ

SEQ ID NO: 428 - protein, 244 aa, Artificial Sequence
  Synthetic
MRAVITGGTRGIGLSAAEALGLAGYDIIITGIDNEAAKTALEELKGKGINAEFVYADSMNEDDVNKCFKYIEEKYGSLDVLVNNVGGLGGRQRFEEMETSFMRRVMALNFDSAFFASRAAIPMLKKGEHPSIINYSTIAVTSGGGPGAGIYSASKAAIEGLTRALAKDLAEYGIRVNAVSPGTIDTEFHAATKREIMETWKSGIVMKRFGEASEVASVIEFLASEKASFLTGEIIQINGGQAFI

SEQ ID NO: 429 - protein, 285 aa, Artificial Sequence; identical to SEQ ID NO: 14
  Synthetic

SEQ ID NO: 430 - protein, 262 aa, Artificial Sequence
  Synthetic
MGKLSGKTALITGASKGIGEGIARTFVKHGANVVLAARGQAVEDLAAQLRAEGAQAMAVRMDVADMDSVRAGYEAGVKAFGAIDILVSNAGICRLGDFLTQSDADRDAHLDINVKGAWNTCKAVLPAMVERKWGKIVIMSSVTGDMVADPGEAAYAMSKAALVGLTKALAREFAPYVNVNAICPGYVLTPMVQGMAVQSCPDNPQSVVDGIASAIPLGRLADPKEVGELAAFLASDEASYLTGAQFVIDGGSTLPETSTMGV

SEQ ID NO: 431 - protein, 250 aa, Artificial Sequence
  Synthetic
MQFDNKVCIVTGGNAGIGRCIAESFIREGARVYVIDRDIDHDTDENIFCYKGDISEKEVLEDFAEWVLSKEEKVDFLINNACLMNGGILSGCSYEDFMYVQKIGVVAPYWLTVLFKEHFSKGASIVNISSSRAFQSQADTESYTAAKGGITALTHALAVSLSGIARVNSIAPGWIETARFHKDTEVPEYSEADIMQHPSQRIGEPEDIARAVMFLCDEKNSFINGTNLTIDGGMGRLMVYHNDNGWKMEP

SEQ ID NO: 432 - protein, 244 aa, Artificial Sequence
  Synthetic
MKQTAIVTGGSRGIGRAVAVRLAKDGMNLVINYRGNSAAAEETERLCRELGAEVLLVQGDVSRAEDCEKLAAQAKEAFGRVDVLVNNAGITRDGLLARMTEEDFRAVLDVNLVGPWNMMKAVNRIMMKQRYGRIVNLSSVTGLMGNMGQTNYAAAKAGILGMTKSYAREVASRGITVNAVAPGFIDTDMTEAMPEGAKDKIITGIPMGRTGKPEDVAEAVAFLASEQAGYITGEVLRVDGGMAM

SEQ ID NO: 433 - protein, 285 aa, Artificial Sequence; identical to SEQ ID NO: 12
  Synthetic

SEQ ID NO: 434 - protein, 262 aa, Artificial Sequence
  Synthetic
MGKLTGKTALITGASKGIGEGIARVFAKHGANLVLAARGSETQALAQSLCESGAKAIAVKMDVSDMASVQAGYETAVQEFGGVDILVSNAGICCLGDFLTQSDADRDAHLDINVKGAWNTCKAVLPGMVARKWGRVVIMSSVTGDMVADPGEAAYAMSKAALVGLTKALAREFAPYVNVNAICPGYVLTPMVQGMARQSCPENPQSVVDGIAASIPLGRLADPMEVGELAAFLASDESSYLTGAQFVIDGGSTLPETSTMGV

SEQ ID NO: 435 - protein, 250 aa, Artificial Sequence
  Synthetic
MSETILVTGASAGFGQAICRRLVADGYRVIGSARRIDKLQALQEELGETFYPLQMDVTNLSQVDHALASLPASWERVDVLVNNAGLALGLAPAYEAEVADWLTMIQTNVVGLTYLTRKILPQMVERNDGYIINLGSTAGTVPYPGANVYGASKAFVKQFSLNLRADLAGKKIRVSNIEPGLCEGTEFSSVRFKGDEERVEALYRDAHAIQPEDIANTVAWLIQQPKHVNVNRIEIMPVSQTFGPQPVYRD

SEQ ID NO: 436 - protein, 244 aa, Artificial Sequence
  Synthetic
MEKVALVTGASRGIGKACALRLAECGYDIVVNYNSNEAKAQEVVSAIEALGQKAVAIKANTADLKEVQNMFREAHKAFGRLDVLVNNAGVVDDAFLLMINEDSLTRSLDINIKGYFHCAQQAALKMMSKKQGVIINVSSVSSILAVDGQGVYSATKGAVNSMTATLAKELAPRGIRVNAVAPGFIETEMLDAIPEDKKEKYLKAIPMHRLGTAKEVADVVAQLCSDAFAYVTGQVIVLDGGLSL

SEQ ID NO: 437 - protein, 285 aa, Artificial Sequence
  Synthetic
MATWLITGCSSGLGKGIALTALERGESVALTARNPDTLTELVKKYPDQALALRLDLNDHPSISNTVSTTYKHFGRLDVLVNNAGHGYRAAVEESERERIEELFETNFFAVGELISKVLPIMRNQRSGLIVNVTSIGAIRGAAGNGYYGASKAAVELLTEALSQEVSHLGIRTLIVEPGAMRTAFFDDALLETKQHISDYDAIAQKYRKSMQTNHHNQPIDPEAAGRVIVDTILSDSMPKRLLLGSDCVKAARNALKARLAEIDEWAEISAQADFSKPQPQSKQKL

SEQ ID NO: 438 - protein, 262 aa, Artificial Sequence
  Synthetic
MGKPYGRSYVLITGATTGIGYELAKLYANDGNNLILVARDEEKLEKVKEELMLLYNINVYSISLDLSEDNSCEKLLNYVNKKNISVDILINNAGLGSFGYLSEIEIEKELNLIDVNVRALTELTKVFLPIMISHGDGAIMNVASTAAFCAGPKMATYYASKSYVLSFTEAIYEELKGTGIKVSCLCPGPVSTGFQDKAGIRKKESAKKALMTPKKVAEIAYRDFKKGKLIIIPGFKNKVIIALNKIMPRSLSRKIILMMNKG

SEQ ID NO: 439 - protein, 250 aa, Artificial Sequence
  Synthetic
MYTSLKGKTAIVTGASRGIGRGIALALASEGVNLVLNATKPASLEEVRMEVEALGVSFDCVAGDMADPETARRLAALAMEKHGRIDILVNNAGIQNRKKVAELSLEEWDRMIAVNESGVFYMCKAVLPFMTKAMQGSIINITSTASKIPHPNAAICYGASKAAVTYLTKHLAMELGPLGIRVNAVQCGPIRSDMTDQWTDEYRAAVMKKIPLGRLGTPEDVAAGVVFLASDEASWITGCSLNCSGGKYTE

SEQ ID NO: 440 - protein, 244 aa, Artificial Sequence
  Synthetic
MRAVITGGSSGIGFATAQVLGREGYEIIVVSFDEKQQEPTLKALAEEGIKASYYLCDVTKEESVNETFARISEKADSVDLLVNAVGGLGGRHEITDMPTEFMRKVMALNFDSVFFVTRACLPLLKKGTNPSIVNFSTIAVTSGGGPGAAIYSASKGAVQSYTRGLAKDLVQFGIRVNAVSPGTIDTPFHAATARELVESWKAGIPMGRLGEASEVATVIKFLASPDASYITGEVIQINGGQAFI

SEQ ID NO: 441 - protein, 285 aa, Artificial Sequence; identical to SEQ ID NO: 11
  Synthetic

SEQ ID NO: 442 - protein, 262 aa, Artificial Sequence
  Synthetic
MVLITDFIRISLKERLLDMNKTVIVTGASKGIGKACAVLFGKNGYNVIVNYSSSAEKASEVCGIINVSGGHAEAFKADVSVRSEVDAMTAFAEKKFGGTDILVNNAGIAEQILFSDITEEKWDRLFAVDVKGVYNCTQSVLPHMIHNKCGKIINISSMWGITGASCEVHYSAAKAAVIGFTKALAKEVGLSGITVNAVAPGVIATEMNGHLDAETMAALKEETPLERIGTPEDVAEAVLFLASEKADFITGQVISVNGGFVI

SEQ ID NO: 443 - protein, 250 aa, Artificial Sequence
  Synthetic
MARYEELTEKRVMITGAASGIGLATAQVFARQGAQVFVVDYNQRAAEQTMAENPAFAGFYVGDVSKEEDVQSAFKKMDAELGGIDVLISNAGISIRADFVDISYEQWKKVIDINLNGMFLCAREAARRMMEQKSGVILMTASTNGTEGHRWYTDYNASKAGVILLTKSMALELAPIVRVNCVCPGYVLTPMQKAEYTEEMLAKVNEGIPMKRHAEPEEVGKLYAFLASDDAKYITGADIRIDGGETAGLY

SEQ ID NO: 444 - protein, 244 aa, Artificial Sequence
  Synthetic
MNKLALITGGTRGIGKQIALTFAKEGYNIAINYRTENDDLKKTKKEVEANNVKCFAVQGDVTNFKDCEQFVKQIVKEFGNIDVLVNNAGITKDTLLMRMKEEDFKQVIDTNLVGTFNVTKNVITYMMKARNGRIINISSVVGISGNAGQTNYAASKAGIIGFTKSLAKEVASRNITVNAVAPGFIETQMTAVLKENIKEEIAKKIPLKRMGTTQDVANVVKFLASSDSSYITGQVIHVDGGMLM

SEQ ID NO: 445 - protein, 284 aa, Artificial Sequence
  Synthetic
MIRKFKNYISRGIRFVVNGEPQVFVRVDSVINGELLKGRNIIITGASSGIGYETAKKCIQEGANVLCIARNEQKLKAAVDRLSAETKNNKIHYLQWDISDISIYKSKCCEAIKMMDGHIDCLVNSAGMTSDVNLSDCTPEKWDTIFNINLKGLYFATSEFVKQFVKQGTGGNVINIASQAGLNAQTRPYALTKAALIHFTFGLAKEYIDQGIRANAVAPGPTVSDMYAINPEGNLKYINRCKRAFRSEEVAETVMFLLSNASNCITGEVIACNGGNSIRTDAYC

SEQ ID NO: 446 - protein, 262 aa, Artificial Sequence
  Synthetic
MSLDTKRIEGKLCIITGAARSVGYEIAERFCQYGGIVAMLDKNPQVVQAAEKLRERGLKAWGYASDVTDRDTIAGLCRELMEEHGPAYVLVNAAGIMEISPFEEATEETWRRVLDINLMGTVNCIQAVIGRMREEGRGKIINFASKAGKMGSKLMTVYGASKGAVITLTQALAMEYAPYKLNINCICPDIIDDTGVWQQANALYAQNLHISREEVKELYEGKVPLGRFATKEDIADLVSFYVISGDDCTGQALNITGGRCMH

SEQ ID NO: 447 - protein, 250 aa, Artificial Sequence
  Synthetic
MKALITGASSGIGRDMARGLARRGYDLILVARRTERLEELGRTLPVQVQTISLDLAQKGNCRALYEQVKDQDLDILINNAGRGLFGPFDETDLEEELAMLDINIRCTHILTKLFLPDFKRRNKGHILNVASSAAFLPGPLLSSYYASKAYVLRLSEAISEELRRAGSQVKISVLCPGPVRTEFNDVAGVRFSIRGLPSPSVAEYAIERMLRGRLVIVPGLDMKLAHLGAHLAPDQLLLRICWHMQKRKQG

SEQ ID NO: 448 - protein, 244 aa, Artificial Sequence
  Synthetic
MNKVAFITGATRGIGRQIAITLAKEGFNIAINYRKENEDLIETKKMVEDQNVKCFTVQGDVSSFEDSERMVKDIIEEFNHIDILVNNAGITKDMLLMRMKKEDFESVIGVNLVGTFNITKNVIPYMMKNRSGRIINVSSVVGISGNAGQTNYSASKAGIIGFTKSLAKEVGSRNILVNAVAPGFIETQMTDVLKEEVKEEISKTIPLKRMGTVEDVANVVKFLASKDSSYITGQVINIDGGMLM

SEQ ID NO: 449 - protein, 284 aa, Artificial Sequence
  Synthetic
MSVLSKIKSLFTYVDIKPLIYDEHLRQAYSSTSVTGGTIKGKNVVVTGATSGIGYATAQRFLSEGCNVILTGRNENKLKEAVGSLTYDNSSQVSYIVMDQLNPSSVKNGVEQAFTISPIDLWVNCAGIFKKTDRSRKFRGITADTFFEVVNTNLKSTVLASRLVADKMVENNTCGQVVNVASICGYSNHFGHTPYGISKTAVIEYTKLLAREYEGKVQFVGIAPGSVATRMGDKGFGKNISGCSSVTKRIAIPEEIASVICFLSSTVGRHLNGKTVIASAMEIV

SEQ ID NO: 450 - protein, 262 aa, Artificial Sequence
  Synthetic
MKDYNRLLEGKRVFITTGARGIGKDIALLFAQQGAQVGVGGRNPESLAKTMEEIRVYSPESKGYVVELSSKEQVEQTAGQVLEDMQGVDILVNTVGINVHGRIDECSDELLERMLETNYKSGLRFSRRFIPGMMERRYGIIINISSIHSVATMPGFGVYAGTKGAMNATARAMALDYADYGIRVNTICPGLIMSDNMMDEVYGYQEGPERDAFMEMLNHMQPLAPGKMEDISDAALYLASDMSSYVTGQIIMVDGGASIKAH

SEQ ID NO: 451 - protein, 250 aa, Artificial Sequence
  Synthetic
MAFDFTGKTVWVTGAGKGIGYATALAFAEAGAQVTGFDLAFPQDDYPFATETLDVADAGQVQEVCGRVLASLDRLDVLVNAAGILRMGATDQLSQEDWQQTFAVNVGGAFNLFQLTMGQFRRQQGGAIVTVASDAAHAPRIGMSAYGASKAALKSLALTVGLELAGSGVRCNLVSPGSTDTDMQRTLWKSDDAEQQRIRGFGEQFKLGIPLGKIARPQEIAATVLFLASDAASHITLQDIVVDGGSTLGA

SEQ ID NO: 452 - protein, 244 aa, Artificial Sequence
  Synthetic
MEKTAIVTGASRGIGAAAALALAAQGCRVAVCCRTRRDSAESVAARIRAAGGTAAVFCADVSDEAAVRTMFAQVEQTLGPADILVNNAGVAQQKLFTDITAAEWDAMFGVCVKGAFHCCQAALPHMIRQKWGRIINISSMWGQVGASCEVHYSAAKAALIGFTKALAKEEGPSGITVNCVAPGVVETDMMAVFSPEDKAALAEETPLCRLGAPEDVAAAVAFLASDAGAFFTGQVLAPNGGFVV

SEQ ID NO: 453 - protein, 284 aa, Artificial Sequence
  Synthetic
MKKIFARFKRIDNRLRPLPYTELLKDSYSTGSVVGGCLKNKTILITGASSGIGLAMVRRFLVEGCHVIISGRTESKLLSAISYLKQKGCDHVTYCLMDQLKDSELYATSQNIFKQFKVNVLINNAGIFKNTDRDGRFRSVDAEDYWPGMNTNLKSSLLLSQSFVDYCKEAEIKGHILNTSSVCGLFESYGITPYGISKAGVIEMTKQFAFAYKGIVTCNSIAPGSVATVMGDLHTGSNIASYSSCNRHVTMTEEIASLAALMCTDDMSEKLNGQTIKACACEKF

SEQ ID NO: 454 - protein, 262 aa, Artificial Sequence
  Synthetic
MGKLSGKTALITGASKGIGEGIARTFVKHGANVVLAARGQAVEELAAQLRAEGAQAVAVRMDVADMDSVRAGYEVGVKAFGAIDILVSNAGICRLGDFLTQSDADRDAHLDINVKGAWNTCKAVLPAMVERKWGKIVIMSSVTGDMVADPGEAAYAMSKAALVGLTKALAREFAPYVNVNAICPGYVLTPMVQGMAVQSCPDNPQSVVDGIAAAIPLGRLADPKEVGELAAFLASDEASYLTGAQFVIDGGSTLPETSTMGV

SEQ ID NO: 455 - protein, 250 aa, Artificial Sequence
  Synthetic
MILDMFSLKGKVAVVTGSNTGLGQGICRAFVEAGAKVVGVSRRPSTETAEMLGENFYNVLADLSSCDVIPKVVEGALEKFGRIDILVNNAGIIKRQDSIEFSEENWDTVMSVNLKTVFFLSQAVAKQFIKQGSGGKIINIASMLSYQGGIRVPSYTASKSAIRGITMTLSNEWAKYGINVNGIAPGYMATNNTQQLRQDEERSADILARIPAGRWGTPADLEGAAVFLASAASDYVNGFTLAVDGGWLGR

SEQ ID NO: 456 - protein, 244 aa, Artificial Sequence
  Synthetic
MLTGKTALVTGGSRGIGAAIVEKLASQGASVAVVYAGSREAAEALCAKCGADFSVKAQAYQCDVADFAAVKDLVAQVKKDFGSVDILVNNAGVTQDGLLAMMKEESFDRVLDVDLKGAFNCIRHCAGLFLRQKAGAIVNVSSVSGLMGNAGQTNYSAAKAGLIGLTKAVAKELAPKGITCNAVAPGFIQTDMTKDLSGQDNGLLAAIPLGRIGQPQEVAEAVAFLACAPYITGEVLRVDGGLAM

SEQ ID NO: 457 - protein, 284 aa, Artificial Sequence
  Synthetic
MNIFLTGASSGIGQALAKEFAANGATLGLVARREDKLKELIAELPNPELHTAIVCDVTNRDHLIEEARKFDACCGGVDIAIACAGISVGVKTQYREDLDVFNKVFDTNVFAMASTFHAFIDPMIKRKRGTLVGIASVAGIRGLPGSEAYCASKSAAITYCESLRVEMQKYGVKVVTISPGFVKTPLTAHNPYKMPFIMEPEAFAKEAVKVIMEGKKYATIPWEMGVLSKILRLIPNWLFDKILASRKQKPRSGANQTVKSTNHQTVPEKQPESPSIADKKGEAK

SEQ ID NO: 458 - protein, 262 aa, Artificial Sequence
  Synthetic
VKHEETAFLLEELPGEGHLCMTGNAGVEEDVRSFAEKVLECFGRVDVLINNACITHRGILSGCSFKEFNEVLRVGVSAPYLLNLLFRDHFSRGASIVNIASTRASMSRKDTESYSAAKGALTSLTHALSMSLSPFGVRVNSVSPGWIDTGLFGVLYPEDAFQHPSGRVGSPEDIVKAVFFLCGSSFVNAENLVIDGGMSRMMVYHGDEGGIPPGTVGQRLLLMGLRFRHAFLCSCFKQVPCRPDAYYAWNWDNSGRAVRLPP

SEQ ID NO: 459 - protein, 250 aa, Artificial Sequence
  Synthetic
MSTCYNPFTLEGKTILVTGASSGIGRQIAIDCSKMGANLIISGRDEVRLNDTLSNLVGEGHLALTADLSDMSQIENLVSQIAGIDGAVLSAGRGLTRPVQFSSPDKMNEVFQINFFSTAELIRLLYKSKKAKKNASIVIIDSIAGITDVSPGNSVYGATKAALNSFSKYCALEFAVRKIRVNCICPGMIETPLIHKGTLTEEQLQEDAKRYPCGRYGRPEDVSNGAIYLLSDASSWVTGTSLFIDGGISI

SEQ ID NO: 460 - protein, 244 aa, Artificial Sequence
  Synthetic
MELKNKNVFVTGSSRGIGLAIAHKFASKGANIVLNSRGELPAGLVDEFASYGVKVVGVTGDVSQAAEAKRMVAEAIDALGSVDILVNNAGITNDKLMLKLTEEDFEQVLKVNLTGAFNMTQSVLKPMTKAREGAIINMSSVVGLTGNVGQANYAASKAGLIGFSKSVAREVAGRNVRVNVIAPGFIESDMTEGLPEKIKEMSLAQIPMKRFGNTEEVADVAVFLATQEYLTGQVIAIDGGLTMQ

SEQ ID NO: 461 - protein, 284 aa, Artificial Sequence
  Synthetic
MENNSPKNRKIWFITGASKGFGLELAKQLLAKGYQVAATTRRLANLEGALGRENASFLPLEVDLINEVSVKNAVAKTIKKFGTVDVVVNNAGYGQFGYIEEISDSLLRKQFDVNVFGTVNVIRAALPALRKQRSGHIFNISSMAGYTGFPGSGIYCASKFAVDGLSESLRDEVADFGIAVTCVKPGNFRTEFLADSMQFEDSSIEDYTEKREAFHVLLKGMNHKQGGDPARGVEIILSVANMEKPPLHLFLGADAYKVASRKIKKVQADMDSIQPVAIDTNFPE

SEQ ID NO: 462 - protein, 261 aa, Artificial Sequence
  Synthetic
MMDVDFSGSAVVVTGGAGGIGRAIAKACAAAGARVAVLDVKHEETASLLEELPGEGHLCVTGDAGVEEDVRFFAEKVLEHFGRVDVLVNNACITRHGILSGCSYEDFNEVLREGVAAPYLLSLLFRDHFSRGASIVNIASTRASMSQKDTESYSAAKGALISLTHALAMSLAPLGVRVNSISPGWIDTGAFGALSPEDGLQHPSGRVGTPEDIVQAVFFLCRSGFVNAENLVIDGGMTRMMVYHGDEGWTFRPEPPDTVPS

SEQ ID NO: 463 - protein, 250 aa, Artificial Sequence
  Synthetic
MEISLKGKVAVVTGGTRGIGYAIVKKYLEAGATVVLCGSKQSTAEAAFAKVKEELPEADVYAMAPSLTDTAAVEEAFKCVFEKFGRFDILANNAGISQSTPLVDYTDEEVDRIMDLNIKAVFVCARAAARIMKENGGGVIVNTSSVVSIYGQPSGCLYPASKFAVNGMTKSLARELAKFGIRVNAVAPGITRTDMVANLPEAMIKPLIARIPIGRMCEPEDVANAFLFLSSELASYITGVVVPVDGAVVI

SEQ ID NO: 464 - protein, 244 aa, Artificial Sequence
  Synthetic
MEKIALVTGASRGIGRAIATELSRRGWAVAIGYRVRRDKAEELARQLTDRGCRAMICQADVSRREQVEAMVHRVEQTLGPISLLVNNAGIAGQCLFQELTDARWHEFFAVNVDGAFYTSRAVLPSMLHEHEGCIVNVSSIWGQRGASCEVAYSATKAALIGLTRSLAAELAPSHIRVNCVAPGVIRTDMLDELPRELLPQLAEQTPMGRLGTPEDIAAAVAFFADPAADFITGQVLTCDGGFIL

SEQ ID NO: 465 - protein, 284 aa, Artificial Sequence
  Synthetic
MSILSKIKSLFTYVDIKPLIYDEHLRQAYSSTSVTGGTMIGKNVVVTGATSGIGYATAQRFLSEGCNVILTGRNENKLKDAVGSLTYDNSSQVSYIVMDQLNPSSVKDGVEKAFTISHIDLWVNCAGILKKTDRSRKFRGITADTFFEVVNTNLKSTVLASRLVADKMLEKNICGQVINVASICGYSNHFGHTPYGISKTAVIEYTKLLAREYEGKVQFVGIAPGSVATRMGDKGFGKNISGCSSVTKRIAIPEEIASVICFLSSTVGRHLNGKTIIASAMEIV

SEQ ID NO: 466 - protein, 261 aa, Artificial Sequence
  Synthetic
MYDDLKGKTVVVTGSSKGLGAAMARRFGAEGMNVVANYRSDEEGARETVRAIEEAGGAAAAVQADVSKNECVDALFDAAMFSFGGVDIWVNNAGIEVASPSDRKSIEEWQRVIDVNLTGVFAGCRRAIDHFLDRKMPGVIINLSSVHEIIPWPHFADYAASKAGVGMLTKTLALEYADRGIRVNAIAPGAMNTPINAEKFADPEARAATERLIPMGYVGAPEDVAAAAAWLASDQASYVTGTTLFVDGGMTLYPGFQFGQG

SEQ ID NO: 467 - protein, 250 aa, Artificial Sequence
  Synthetic
MVFDFTGKTVWVTGAGKGIGYATALAFADAGAKVTGFDLAFPQENYPFATQTLDVSDAAQVSDVCGRLLAVEERLDILVNAAGILRMGATDQLSQEDWQQTFAVNVGGAFNLFQQTMGQFRRQQSGAIVTVASDAAHTPRIGMSAYGASKAALKSLALTVGLELAGSGVRCNLVSPGSTDTDMQRTLWTCDDAEQQRIRGFGEQFKLGIPLGKIARPQEIASTILFLASDAASHITLQDIVVDGGSTLGA

SEQ ID NO: 468 - protein, 244 aa, Artificial Sequence
  Synthetic
MSFEGKIALVTGASRGIGRAIAETLAARGAKVIGTATSENGAKAISDYLGANGKGLVLNVTEPASIESVLENIRAEFGEVDILVNNAGITRDNLLMRMKDDEWNDIIETNLSSVFRLSKAVIRAMMKKRHGRIITVGSVVGTMGNAGQANYAAAKAGLIGFSKSLAREVASRGITVNVVAPGFIETDMTRALTDEQRAGTLAAVPAGRLGDPKEIASAVAFLASDEAGYITGETLHVNGGMYMV

SEQ ID NO: 469 - protein, 284 aa, Artificial Sequence
  Synthetic
MISRIKLYLSRAVRFVISGEPKVFVRVDSVQQGKLLFGKNIIITGASSGIGYEIAKKCLLEGGNVLCVARNEEKLMAAIEKLKNETGNDDVHYLQWDIADISVCENKCRKAIDLLGGHIDCLVNSAGMTSKVNIADCTPEQWDNIFNVNLKGLFFITSEFVKQFVRQESGGNIVNIASQAGLNAQTRPYALTKAALIHLTTGLAKEYVSYNIRVNAIAPGPTVSDMFSVDPNGDLHSGNRCKRAFRSEEVAETALFLLSNASNCITGEVIACNGGNSIRTDAFC

SEQ ID NO: 470 - protein, 261 aa, Artificial Sequence
  Synthetic
MELKDKRILVTGGGSGMGRELILTLLEKGCYVIAVDINEDGLKETYRLTGSHKRFTYAVTDIADTRAVNCLANNILSCSDIDGVINNAGIIQPFLHTEFIAHDVAKRIFNVNFWGTLNMIQSFLPHLKKRPNAMLVNVSSMGGFLPIPGQSIYGASKAAVKMLSESLNIELRSTNVKVITVFPGAMNTDIKKNSEIADDATLENAKNALQPNVAARIIITAVEKENATIYIGEDSKMMRQLYEIDPERAINVISSTINHKI

SEQ ID NO: 471 - protein, 250 aa, Artificial Sequence
  Synthetic
MNLLEGKVAIITGGTRGIGFGIAHKFLENGAKVAICGSRQETVDAALAKFAEINPDYPVMGITPKLTDPESITAEFAKVVETFGRLDILGNNAGKESRTHLLDYTPEELQSIMDLNVLSVFYTCQVAVSIFREQGDGGCIINTSSMVSRYGQPSGSAYPTSKFAVNGLTLSLARELAPDHIRVNAVAPGVTHTDMVDGLPDEIIKPLIASIPLGRMAEPEDIANAYLYLASDLASYVSGIVLPVDGLARS

SEQ ID NO: 472 - protein, 244 aa, Artificial Sequence
  Synthetic
MEKVALVTGASRGIGAAIAKVLASDYRVIVNYKSSEKLAEEVVNEIREAGGEAESFQADVSKEEDVVKLFKYIKTIYRRIDVLVNNAGVTADNFLMSMNLDNWNKVINSDLTSVFLCCREASKIMHYFKIPGRIVNIASVSGLIGLEGQANYSAAKGGVIALTKAVAKELVADKVVVNCVAPGFIESDMTKAVNQKLVQKMLENVSVKRYGTALEVAKFVQFLCSDDVEYITGKVFTIDGGMVY

SEQ ID NO: 473 - protein, 284 aa, Artificial Sequence
  Synthetic
MKKIFARFKRIDNRLRPLPYTELLKDSYSTGSVVGGSLKNKTILITGASSGIGLAMARRFLVEGCHVIISGRTESKLLSAISYLKQKGCDNVTYCLMDQLKDSELYATSQNIFKQFKVNVLINNAGIFKKTDRDGRFRSVESEDYWPGMNTNLKSSLLLSQSFVDYCREAEVKGHILNTSSVCGLFESYGITPYGISKAGVIEMTKQFAFAYKGIVTCNSIAPGSVATVMGDLHTGSNIASYCSCNRHVAMAEEIASLAALMCTDDVSEKLNGQTIKACACEKF

SEQ ID NO: 474 - protein, 261 aa, Artificial Sequence
  Synthetic
VYYIDKSVYIYTLDMGRLSGKIALVTGASRGIGRAIAIELAKEGASIVINYSKDHDGAEKTLEEIKRVNGYGVLIKEDISSYENTKIMVDEIISTMGKIDILVNNAGISKIGLFMDSDKENIDHIMNVNLLGPIYLTKHVINYMIPRKSGNIVNISSIWGETGASCEVLYSATKGGINLFTRSLAKELAPSNIRVNAIAPGVIDTPMNSFLTENEKSELEEEIPLGRFGKPEEVGRLTAFLCSDDSSYITGQVIRTDGGFI

SEQ ID NO: 475 - protein, 249 aa, Artificial Sequence
  Synthetic
MIIFITGASAGFGEAIARHFINHGHKVIGTARRLDKLQALHQELGDLFYPLQLDVTDKKAVSEIYHQLPEQWRSIDVLVNNAGLALGLSTADKANLDDWDTMIETNNKGLVHVTRALLPSMVERNVGHIINISSTAASWPYMGGNVYGATKAFVKQFSLGLRADLQGKKIRVTDIEPGLVGGTEFSLVRFKGDTDKVEQTYAGADALTPEDVAQAVFWTATLPAHVNINTLEMMPVSQSFAGLSVHRQN

SEQ ID NO: 476 - protein, 244 aa, Artificial Sequence
  Synthetic
MEKKVALITGGSRGIGKAIAEKFAKNGYDLVINYVSDNTDLDAIKEEFKQYGSEVLMEKADVSNFEQCEKMVTAAIEKFGRIDVLVNNAGVTRDNLLMRMKEEDFDKVISINLKGTFNLTKLVTPYMMKRREGRIVSISSVVGVMGNAGQSNYAASKAGIIGFTKSVAKELASRNILANCVAPGFIATDMTAVLNDKVKESINAQIPLKRMGTAEEIANAVYFLGGEENTYITGQTLNIDGGMI

SEQ ID NO: 477 - protein, 283 aa, Artificial Sequence; identical to SEQ ID NO: 16
  Synthetic

SEQ ID NO: 478 - protein, 261 aa, Artificial Sequence
  Synthetic
MSLRIAVTGGSSGIGLAIARQFAAKGHTVYSLSRRPSADGVRHIPCDVADESSVRQAFAALEQAEGALDILVNNAGFGISGAAEFTDLDKAKALFDVGYFGLLACVKHALPLLRKSASPLIVNVGSLAAALPVPFQSVYSSAKAAVSALTLCLVNELRPFGVRVCAVLPGDVRTGFTAKRDKSQEGRALYGDRLERAVARMEADEQNGMPPERIAAAVCRAAMKRRPKPLFTVGAGYKTLLVLSRLLPARWVNRIEGRLYG

SEQ ID NO: 479 - protein, 249 aa, Artificial Sequence
  Synthetic
MIIMVTGATAGFGESITRRFVANGHKVIATGRREERLKTLKDELGDNLYIAQLDVRNRAAIETLIADLPAEWQAIDVLVNNAGLALGLEPAHRASVEDWEDMIDTNNKGLVYMTRAVLPGMVERNRGHIINIGSTAGSWPYAGGNVYGATKAFVRQFSLNLRTDLHGTAVRVTDIEPGLVGGTEFSNVRFKGDDAKAEKAYENTQALTPEDVTEAVWWVATLPKHVNINTLEMMPVSQSFAGLSVHRQG

SEQ ID NO: 480 - protein, 244 aa, Artificial Sequence
  Synthetic
MLKGKTALITGGARGIGAAITATLAAQGANVAVIYAGSQEKAEALCAQCAKDHGVQAQAYQCDVADFAAAKAVVAQVKKDFGAVDVLVNNAGITQDGLLAMMKEESFDRVLAVDLKGAFNFIRHCTPLFLRQKGGAIVNITSVSGMIGNPGQANYAAAKAGLIGLTKAVAKELAPKGITCNAVAPGFIATDMTRDLAGQDNALLAAIPLGRMGQPQEVAQAVAFLATAPYITGEVLRVDGGIAM

SEQ ID NO: 481 - protein, 283 aa, Artificial Sequence
  Synthetic
MRKKAIVTGASRGIGKGIAMCLAEEGYDLAISYVSKKEEADKVVEQISETYHTRCFAYQAALQEKGAGKALFDQAVADLGGLDLLVNNAGLTIFESLQDIQEETLDLLINLDFKNYILMMREAANYMIASGTKGNIINITSSRGEQSYPEDGLYGGLKAGLNRAICSFALDVSQYGIRINNVAPGAIRIRTREELIEGGNVAMADFWDELGNRIALGRSGLPEDIGHAVAFLASDKASYITGTTLRVDGGLILPGMPEMITEGLKPGEWRSVAKPVKNKGFSL

SEQ ID NO: 482 - protein, 261 aa, Artificial Sequence
  Synthetic
MYRDLKGKVAVVTGGSKGIGAGIAERFGKEHMAVVINYLGDHEGARKTADTVIKNGGQAVSIHADVSTEAGIASLVKTAESEFGRLDVWVNNAGMEIKAPTHEVSLDDWNKVIAINQTGVFLGARAALNYFLDHHQPGNIINITSVHEQIPWPTFASYTAAKGAVKLFTETIAMEYANRRIRVNAIGPGAIETPINAEKFADKAQYDQTVAMIPQGRLGKPEDVAAGAAWLASTESSYVTGTTLFIDGGMTLYPAFKDGQG

SEQ ID NO: 483 - protein, 249 aa, Artificial Sequence
  Synthetic
MSNKYSIVTGASRGLGAAIAEELAREGYDVVITYCTQADKAQKVKKQLETKFGVRVESYQLDIKDEEAVLAFRKWVEETLGTNLQVLVNNAGIYANMPAEEIASKTFCDIIDVNVKGTFFMTRHFVDLMIANHYGKIINLCSAVGLRAAPGSIAYASSKFAIRGMTQALAIDLGKYNIQVNAIAPGAHKTDMYWDAYKIDPELLEKRTKGCPLQRAGEVSEMYHIVRYFLASDFITGQVVSPNGGTTMV

SEQ ID NO: 484 - protein, 244 aa, Artificial Sequence
  Synthetic
MELKNKNVLITGSTRGIGLAIAHKFASLGANIILNGRGEVSENVLAEFKDYPVKVFAVTGDVSDSADAKRMVEEATLALGSVDVLVNNAGITKDKLMLKLTEEDFEQVLKVNLTGAFNMTQAVLKPMTKARQGAIINMSSVVGLTGNIGQANYAASKAGLIGFSKSVAREVAARNIRVNVIAPGFIESDMTDGLPEKIKEASLAQIPMKRFGNTEEVADVAVFLASQEYLTGQVITIDGGLTMQ

SEQ ID NO: 485 - protein, 283 aa, Artificial Sequence
  Synthetic
MADNYIERKMEELRSGKSASVRARRTPSGARAGHLDLKFPPRRVVVTGGASGIGRAIVKAYADAGCRTAFFDVDTDAGTATARATGSRFIPLDLRDAGLFQSRLEELLHEWGDIDIVINNAGVANFHPIEQTTVEEFDDVLAVNLRPAFVAARTLAIHRRGLAVPNPYGRIINVASTRAFQSETGTEAYSASKGALVALTHALMMSLSPYGITVNSISPGWIETGDYDRLSATDHSQHPSGRVGRPDDVARLCLMLSLPDNDFINGENIVVDGGMTRRMIYAD

SEQ ID NO: 486 - protein, 261 aa, Artificial Sequence
  Synthetic
MKKVAIVTGGTRGIGFAIAQRMIKAGFATCIMSRSSEADCAEALSKLRATQSAQPPEVFYMAGGIGVAADREAFVGEVVKRYGRVDVLVNNAGVAPKVRADLLEATEESFDYVTGINLKGTMFMSQLVANQMLSQPAPEEGMRGVIVNISSFSATVSSPNRPEYCVSKAGISMLTRLFADRLAGEGIYVYEVQPGVIKTDMTAKVQEKYDRLLAGDQFPIHRWGTPEDVANVVDIFVRGDMRYTTGQVIYVDGGYMNIRSI

SEQ ID NO: 487 - protein, 249 aa, Artificial Sequence
  Synthetic
MTIHMKEKVALVTGAGSGIGQAIAKYLAEAGATVVIIGRTESTLKETAELNKNISYLVSDISIDENITAIIDEVKKRYARLDVLINNAGVAPVTPLAEVLLQEYDTAFITNVRAVVDLTRQALPMLKAVRGNVINISSTAAEKPIPNMSIYSASKAAMSALTKSWAKEMAKDGVRFNNVIVGPIETPIYDKTDLSDEGAQKHREFVLGTIPMGRYGEPNDVASAVLFLASDETKFVTGADFAVDGGVRA

SEQ ID NO: 488 - protein, 244 aa, Artificial Sequence
  Synthetic
MEKRVALVTGGSRGIGRAIAEKFAKNGYNLVINYVSDNTNLDEIKEGFSKYGVEVLLEKADVSNFNECEKMVTSAIEKFGKIDTLVNNAGITRDNLLMRMKEEDFDKVISINLKGTFNLTKLVTPYMMKKRKGRIVNISSVVGVMGNAGQSNYAASKAGIIGFTKSVAKELATRNILANCVAPGFIATDMTSVLNEKVKENISAQIPLKRMGTAEEIANAVYFLGGEENTYITGQTLNIDGGMI

SEQ ID NO: 489 - protein, 283 aa, Artificial Sequence
  Synthetic
MVSARVSFINKLRKGDFKMSVNFSLEGKVALVTGASYGIGFAIASGMAKAGATIVFNDIKQELVDKGLAAYKEAGIDAHGYVCDVTNEEAVNATVEKITKEVGPIDILVNNAGIIKRIPMCEMTAAEFRQVIDVDLNAPFIVSKAVIPSMIERGHGKIINICSMMSELGRETVSAYAAAKGGLKMLTRNICSEYGKYNIQCNGIGPGYIETPQTAPLRERQPDGSRHPFDSFIVAKTPAERWLKPEELAGPAVFLASEASDAVNGHILYVDGGILAYIGKQPQ

SEQ ID NO: 490 - protein, 261 aa, Artificial Sequence
  Synthetic
MKALITGASSGIGRDIARILAKKNYDLVLVARDEQKLKELEKELKENNNIKIETISMDLSQEENCIDLHKNVKDVDILINNAGFGDCGNFTHTELKKELSMIKTNIIAYHILTKLYLVDMKDKNSGKILNVASIAGFMPGPLMATYYSTKAYVVRLSESIREELRKEKSKVQISILCPGPVNTNFNNVANVKFHMREASSYEVAKFAIKKLLKGKFYIIPGLDVKAGIFFSHFVPNSFVAKITYMVQKKKIRPKPLTNLKK

SEQ ID NO: 491 - protein, 249 aa, Artificial Sequence
  Synthetic
MDQTMEGKVAVVTGASRGIGKAIAVKLASKGATVVINYNGSRERAEEVKNEVESAGGKAVIIQCNVADFDACKEFIETVIKEQGRIDILVNNAGITKDGLLMKMSEEDFDKVLDTNLKGTFHTIRAALRQMIRQRSGRIINMASVVGVSGNAGQANYAASKAGVIGLTKTAAREVASRGITVNAVAPGFIETDMTEVLPEKIKEASAAQIPLGKFGKAEDVANAVAFLASEDAGYITGQVLHVDGGMVM

SEQ ID NO: 492 - protein, 244 aa, Artificial Sequence
  Synthetic
MSFEGKIALVTGASRGIGRAIAETLAARGAKVIGTATSESGAQAISDYLGANGKGLMLNVTDPASIESVLENVRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALTDEQRAGTLAAVPAGRLGSPNEIASAVAFLASDEAGYITGETLHVNGGMYMV

SEQ ID NO: 493 - protein, 282 aa, Artificial Sequence
  Synthetic
MDSPVWLITGASRGFGNSFARVALANGCRVVATARKPAAVVASLGEHDDLLPVELDVTDTQSIKTAVAQAIEAFGRIDVLVNNAGFGIFGSLEETTDEEMRAIYETNVFGAMNVTRAVLPIMRAQGSGRIINMGSMASFACDPGGTLYDSTKFAIAGMSEALALEMKPFGIESMVVEPGMFRTNFFDGSSIRTPANPLAAYDGTPARGAEEYCLGHNYQQNGDPDKAAAFVYRVVADEDTPLPLWLPVGKDAFKKFEKKLTAMVESVSSYREEGSDLFVDQS

SEQ ID NO: 494 - protein, 261 aa, Artificial Sequence
  Synthetic
MCRYQRFTGKSVVVTGAASGMGKAITVDFLKEGADVVAVDINVEALEELKNAVSEKAEEYAGTLTTYCGDIALQETNENMIDTALNKFGKLDCLVVNAGVGGRSETITELTNEAWETVMRVNLYGPMYAIRKAVSVMLKQETGGNIVSIASVAGIRGCRSSVQYTAAKHGLVGLCEHTAYAYMHDGIRSNLICPGAIKTGMTTRGIPESEFGASRIWSGMDSHVQTGVPEDISQAVLYLASDEARFINGATLVIDGGMSCN

SEQ ID NO: 495 - protein, 249 aa, Artificial Sequence
  Synthetic
MIVLITGATAGFGEAFARKFIENGHTVIGTGRRIERLAKLQKEFGNKFFPLALDMTDSPAVDNVINSLPESLREIDVLVNNAGLALGMETVDKGNPAEWDVVVDTNIKGLLHMTRAILPGMVERNRGHIINLGSTAGSWPYAGGNVYCGTKAFVRQFSLALRADLAGKKIRVTDIEPGMVGGTEFSGIRYRGDEEKAANTYKNTDPLMPDDIAEAVFWVATLPSHVNINTMEMMPVCQSFAGLSVHREG

SEQ ID NO: 496 - protein, 244 aa, Artificial Sequence
  Synthetic
MELKNKNVFVTGSTRGIGLAVAHKFASLGANLVLNGRSDIPEDLLAQFSDYGVTVVGISGDISNGEDAQRMVTEAIEKLGSIDVLVNNAGITNDKLMLKMTEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMLAQVPMKRIGQAEEVAEVAAFLATQEYLTGQTIAIDGGMTMQ

SEQ ID NO: 497 - protein, 282 aa, Artificial Sequence
  Synthetic
MADNYLERKMEEHRAGRGVSYRPKLTPTGKRQGELTVKFPPRRVFVTGGASGIGRAIVKAFCDAGCRVAYCDIDSAAGTRTAQSLGARFYPVDVSDTCALEACLQSIFDLWGDIDILVNNVGVGDFKPLTEASVEDFDRVMNVNVRPVFVTSRKLALHRASLAEHDGYGRIINLCSTRHAMSEAGTEAYSASKGAIASLTHALMMSLAPYGITVNAISPGWIETGDRTVLTDADHAQHPSGRVGEPADIARLCVYLSLPGNEFINGENITVDGGMTRKMIYV

SEQ ID NO: 498 - protein, 261 aa, Artificial Sequence
  Synthetic
MKNTAVITGASGGLGREFARLFAKDGYNLILAARNGEKLQKLKEETEKEYGVTAEIFICDLSETEAPEKLFAFCKEKQAEIAALVNNAGFGDFGEFYRSDLTKQTEMVQVNDMALMRLTRLILPQMIARKSGKILNVASVAAFAPGPLMSVYYATKAFVLSFTEALAVETKPYNVSVTALCPGPTKTGFESAAALEKSGLFKNLKNADAAKTAAFGYKKMNKGKVIAVHGAGNRFLVRMMKFAPRALVRKCVYKIQKEKQS

SEQ ID NO: 499 - protein, 249 aa, Artificial Sequence
  Synthetic
LNYKTALITGGSEGIGLACAMKLHGSGYSVCLLSRSKEKLTAAVHTIQNTPGERNSPETGPGTIFTIPCDISRNIPVHEAVEQASQKMGSIDVLLNCAGCSMHAPSPFEDVNEEEYLRIMHTNTDGLFRVTQAVLPIMKKQESGYIINILSTASHAAGAGNAPYSASKYAAKAMTDTLIEEYRGTGIRISSISPGPVATTIWSHKTTPPDSSRLARMLRPQDIADIAAYLLSTPANVHIQDLLVTPWNY

SEQ ID NO: 500 - protein, 244 aa, Artificial Sequence
  Synthetic
MLTGKTAVVTGGSRGIGAAIVRKLASQGANVAVVYAGSQALAEELCAQCAAEFSGKAVAYRCDVADFAAVKDLMAQIKKEFGTVDILVNNAGVTQDGLLAMMKEESFDRVLDVDLKGAFNCIRHCAGMFLRQKHGAIVNVSSVSGMIGNPGQANYSAAKAGLIGLTKAVAKELAPKGITCNAVAPGFIETDMTRDLSGQDNGLLAAIPLGRMGQPQEVAEAVAFLVTAPYITGEVLRVDGGIAM

SEQ ID NO: 501 - protein, 282 aa, Artificial Sequence
  Synthetic
MKKTWLITGCSSGLGRSLAKETLKQGYNVVVTARNTDTIQEIVDQYPQSALGIALDVTNQESIRNAVKQAIDCFGFIDILVNNAGYGYRSAIEEGTRQDISKLFETNVWGPVALIKQVLPFMRAKHQGAIINVSSIAAIHASMGSGYYAASKSALESISESLKKEVEPLGIKVMIVEPGAFRTNFTGSSLTQSPKAIEDYALTAGTRRIEKEKNHGKQPGNPDQAAPLIIQAIESEKTPLRLLLGSDAVNYAHDMLAEHQKDYDKWCELSKKTDYKKDDDLF

SEQ ID NO: 502 - protein, 261 aa, Artificial Sequence
  Synthetic
VKITFSWSFYRFDKVWRDKMLEGKTVIVTGAAKGIGKAIAIAFAKEGCNIVLNYHSSVSDETVKEIEEQGVKCMPVQGDVSDFDFAKNLIRDVKKEFGSIDVLVNNAGITKDMLLMRMSEEQFDSVINTNLKGSFNMIRHASSVMLKQRSGAIINMSSVSGVAGNIGQANYAASKAGVIGLTKATAKELAQRGVTCNAIAPGFIETDMTAVLNDDTKDAILNSIPLSRAGKPEDVANAAVFLAKNSYITGQVLNVDGGMIM

SEQ ID NO: 503 - protein, 249 aa, Artificial Sequence
  Synthetic
MIILVTGATAGFGESITRRFIANGHKVIATGRREERLKTLKDELGENLYTAQLDVRNRAAIEELIAGLPADWQAIDVLVNNAGLALGLEPAHKANIEDWEDMIDTNNKGLVYMTRAVLPGMVERNRGHVINIGSVAGAWPYAGGNVYGATKAFVRQFSLNLRTDLHGTALRVTDIEPGLVGGTEFSNVRFKGDDAKAEKAYENTQALTPEDVTEAVWWVATLPKHVNINTLEIMPVSQSFAGLNVHRQG

SEQ ID NO: 504 - protein, 244 aa, Artificial Sequence
  Synthetic
MELKGKNVFITGSTRGIGLAMAHKFASLGSNIVLNGRREIDEELVSEFSDYGVQVVSISGDVSDSTDAKRMVEETIEKLGSVDILVNNAGITKDKLMLKLTEEDFEQVLKVNLVGAFNMTQAVLKPMSKARQGAVINVSSVVGLIGNVGQANYAASKAGLIGFTKSVAREVAARNVRVNAIAPGMIESDMTDILSDKVKEATLAQIPMKRFGNTSEVAEVAVFLARQEYLTGQVIAIDGGLTMR

SEQ ID NO: 505 - protein, 282 aa, Artificial Sequence
  Synthetic
VNNPYGKVTLITGASSGIGKCTAEELMNRGFRVYGVSRSGGRDKRSEDGFLRMLCMDVCDEASVRSAVDEVIAKEGRIDILINGAGIGICGAVEDCSAKDAVKQMDTNYFGVIRMLNAVLPHMRERRNGLIINIGSVGGIFSIPFQTLYSSSKFAVEALTEGLRMELRPWGIKAALVEPGDTKTGFTGARRYAEGTDKSAYGDAFKSSIAQMEKDERNGMPPNSVTKAILSLIKSKNPPVRRTVGIKYKLFVGLKRFFPARVVELILTSIYAKGDKPDGKQT

SEQ ID NO: 506 - protein, 260 aa, Artificial Sequence
  Synthetic
MEENRVKGKIAFISGASSGIGKATAEKLAQMGVNLILCARRENILNELKESLEKQYGIKVKNLVFDVRNYDDVLKNINSLDDEWKKIDILVNNAGLAVGLEKFYEYNMEDVDKMVDTNIKGFVYIANTIIPLMLATDKVCTIVNIGSVAGEIAYPNGSIYCATKFAVRAISDAMRSELIDKKIKVTNVKPGLVDTGFSLVRFRGDKEKADNVYKGIDPLYAEDIADTVAYIVNLPEKIQITDLSITPLHQANAIHIYKEK

SEQ ID NO: 507 - protein, 249 aa, Artificial Sequence
  Synthetic
MIILVTGATAGFGECITRRFIANGHKVIATGRREERLKALKEELGDNLYTAQLDVRNRAAIEEMIAGLPAQWQAIDVLVNNAGLALGLEPAHRASVEDWEDMIDTNNKGLVYMTRAVLPGMVERNRGHIINIGSTAGSWPYAGGNVYGATKAFVRQFSLNLRTDLHGTAIRVTDVEPGLVGGTEFSNVRFKGDDAKAGKTYENTQALTPEDVTEAVWWVANLPKHVNINTLEMMPVSQSFAGLSVHRQG

SEQ ID NO: 508 - protein, 244 aa, Artificial Sequence
  Synthetic
MSFEGKIALVTGASRGIGRAIAETLVARGAKVIGTATSESGAQAISDYLGANGKGLMLNVTDPASIESVLENIRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALSDDQRAGILAQVPAGRLGGAQEIASAVAFLASDEASYITGETLHVNGGMYMV

SEQ ID NO: 509 - protein, 282 aa, Artificial Sequence
  Synthetic
MGRLSLKNALKRYVKGMRPININVNNVHVAPNELLKGKNAVITGAGSGIGKAIAVAMIQSGATVVGLGRNKDKLIKASEEIGEKYIPYVCDVSEVNDLKKRISEIADQFDNKHIDILVNCAGTKTGNDEVFFKTTPEEFDMVINTNLRAPFFWCQQVARHMVEHGISGHIVNIISIKGFIGEASPYSVSKWGCTSLTKGLARMLAPNGIVVNGIAPGGTKTEMAHLKEDSYLHLATPSMRLADPNEIANIAVFLASDLGCNIIGDVIVCDGGQMLQYGNDRI

SEQ ID NO: 510 - protein, 260 aa, Artificial Sequence
  Synthetic
MERKVVLITGATSGIGEACARKFAEGGYDLILTGRNEEKLKAICEKVKAFGADVLPLTFDVRDREAATAAVESLQGKWKTVDVLINNAGLALGLDKEYEGDWEDWTTMIDTNIKGLLIMTRLVVPAMVERNKGHIINIGSVAGDAAYAGGNVYCATKAAVKALSDGLRIDVAHTAVRVTNVKPGLVETNFSVVRFHGNQEKADNVYKGVQPLTGDDIADVAFYAASAPEHVQIAEVLVLATHQANGTVIDRNPDRVEHLS

SEQ ID NO: 511 - protein, 249 aa, Artificial Sequence
  Synthetic
MELFNPYSLSGKTILVTGSSSGIGRGIAITCAQLGATVICQGRNKKKLEDTIEQMPNGTHKLIVGDLTKLEEIFQLVSSLPPLDGIVHCAGVGQRKLCKQLEEADINTVMDINFKAPVMLQAEILKQKKIKKQASIIFITSIASESPSIGNAIYSASKGALKAYSKCLALELAPRQIRVNCVSPAMVWTDLIINDVIIKEDLLEDEKRYPLKRYGKPEDIAYLVGYLLSDASVWMTNSNLNITGGVDQL

SEQ ID NO: 512 - protein, 244 aa, Artificial Sequence
  Synthetic
LRFENRCAIVTGAAQGLGFAIAKRLNDEGCKVAMLDINEEKVSASAAQLSGCFGMKCDVSSAEDISRAVKAAAEKLGGVDILVNNAGILHNSSIPDTTEKEWDTVMAVNLKSVFFMVQQCLPYLKESKYPRIVNISSLAGRMGGFETGLAYSASKGGIIALTMGLARQLSPFKINVNAVCPGTTETPITKAFTPEAMERLLTRIPLGRLGKPEDMAAAVAFLASDDAAFITGLLMDVNGGMYMG

SEQ ID NO: 513 - protein, 281 aa, Artificial Sequence
  Synthetic
MNSESKTKKKGETNMDIMKNFSLEGKIALVTGASYGIGFAIAKSYGKAGATIVFNDINQELVEKGVKAYAEEGIEAHGYVCDVTDEEMVNELVAKVEKEVGIIDILVNNAGIIKRIPMLEMKAEDFRKVIDVDLNAPFIVSKAVIPGMIKKGHGKIINICSMMSELGRETVAAYAAAKGGLKMLTKNIASEYGEHNIQCNGIGPGYIATPQTAPLRELQADGSRHPFDQFIIAKTPAARWGTPEDLTGPAIFLASDASDFVNGHVLYVDGGILAYIGKQPQ

SEQ ID NO: 514 - protein, 260 aa, Artificial Sequence
  Synthetic
MTKCMIGALKGKAAVITGGGSGIGKAMVERYLAEGASVVAADINEESLKVLQEELEPEYGDKLKIRRVNVSSKEEVEAMIDYTIEAFGKVDVVINNAGIMDNLLPIAEMPDDMWERIMNINLNSVMYACRKAVQYFLKENREGTIINTASLSGLCAGRGGLAYTTSKFAVVGLTKNVAFMYSDAGIRCNALCPGAIESNIGSGMREPSKLGFTKAVTGNAGRHRNGSADEVATAAVFLASDAASFINGETLTIDGGWSAY

SEQ ID NO: 515 - protein, 249 aa, Artificial Sequence
  Synthetic
MIILVTGATAGFGESITRRFIENGHKVIATGRRQERLQELKDELGDNLFTAQVDVRNRAAIEEMLANLPAEWKEIDVLVNNAGLALGLEPAHKANVDDWETMIDTNNKGLVYMTRAVLPGMVERNRGHIINIGSTAGSWPYAGGNVYGATKAFVRQFSLNLRTDLNGTAVRVTNIEPGLVGGTEFSNVRFKGDDAKAEKTYENTNALTPEDVTEAVWWVATLPKHVNINTLEMMPVSQTYAGLSVHRAG

SEQ ID NO: 516 - protein, 244 aa, Artificial Sequence
  Synthetic
MRAVITGGTRGIGLSAAEALGLAGYDIIITGIDNEAAKTALEELKSKGINAEFIYADSMNEDDVNKCFKTIEEKYGSLDVLVNNVGGLGGRQRFEGMETSFMRRVMALNFDSAFFASRAAIPMLKKGEHPSIINYSTIAVTSGGGPGAGIYSASKAAIEGLTRALAKDLAEYGIRVNAVSPGTIDTEFHAATKREIMETWKSGIVMKRFGEASEVASVIEFLASEKASFLTGEIIQINGGQAFI

SEQ ID NO: 517 - protein, 281 aa, Artificial Sequence
  Synthetic
MKNTENHQKIVIITGASNGMGYEAAKTFAQRGWQVYAGARRVEKIPTDAGIIARKLDVTDSKSNQDFVKHVIDKAGRIDVLINNAGYGEYGPAEEIPMENVRKQFETNFFGAVELTQLVLPIMRQQHFGRIVNISSIGGDVYMPLGAFYHATKAALQQWSDVLDTEVKAFGIRSIVVQPGGTASNWSTIAMENAEKNLQPDSPYQPLVQTVRAALSGNFGSSATSADLAQVFYKAATDNKAKSRYYNSLLDRVMVHTARAHPKLYIKFFNLGLKQMGKRKK

SEQ ID NO: 518 - protein, 260 aa, Artificial Sequence
  Synthetic
MSEARHNPVLAGQTAVITGGASGIGKSIVQRFLEAGASCLAADLNEEALAALKQELAEYGDKLDVVKVDVSSRDDVDGMVDRAVQTFGQMDIIVNNAGIMDNLLPIAEMDDDVWERLMKVNLNSVMYGTRKAVRYFMERGEGGVIINTASLSGLCAGRGGCAYTASKFAVVGLTKNVAFMYADTGIRCNAICPGNTQTNIGVGMRQPSERGMAKATTGYAGATRSGTPEEISAAAVFLASDQAGFINGETLTIDGGWSAY

SEQ ID NO: 519 - protein, 249 aa, Artificial Sequence
  Synthetic
MDLNLKNKIALVTGGSRGIGKKIAEALANEGANVVVTATNINKAQEVADELKSKYNVETLALVHDVKSSESCKDVVAKTIEKFGSIDILVNNAGITRDILVIQMDDSAWNDVIDTNLSGAFYTSREAAKSMLRARKGKIINISSVIGKMGNAGQVNYAAAKAGIIGITKSMAKEFAPRGICVNAIAPGFIQTDMTGVLAEDAVKKIMDITPLKKLGNAEDVANIVVFLASDLSNYITGEVIAVDGGMSM

SEQ ID NO: 520 - protein, 244 aa, Artificial Sequence
  Synthetic
MNKVALITGGTRGIGKEIAYTLAEENYDIIINYRTENEELMKLKKEIEQKRVRCLLLKGDVSNFEDCKKLVEEAINRMNHIDVLVNNAGITKDMLLMRMKPEDFNEVINVNLIGTFNMTKNVINYMMKERKGRIINVSSVVGISGNAGQTNYSASKAGIIGFTKSLAKEVASRNILVNAIAPGFIQTDMTNILKENVKDEIAKTIPLKRMGTAKDVANVVKFLVSEDSSYITGQVIQVDGGMLM

SEQ ID NO: 521 - protein, 281 aa, Artificial Sequence
  Synthetic
MNELREKVWIVTGASGGLGLAIVKTLLKENIRVAAFSRSAERMEAAVGHGEQERFLALSVKLHDEQSVIEAKKRVLAKFGTVDVVVNNAGHGQRGAIEEVTDPEARAMLDDNFFSQLNMMRQFIPVMRENGGGYFINMGSISSFTVKACSGIYAISKYAVNALTEAINQEGVPFHIRATCVKPFDLRTNYLASNHLKQPKVIIDCYNPIHQAHEVDDNETHGGQPGDPNKVAELFIKLAEEPKPPCSLFLDYPVEELVHRVIDGRRAEIDKWEKLACEFDA

SEQ ID NO: 522 - protein, 260 aa, Artificial Sequence
  Synthetic
MYNESRVMGKIAFITGATSGIGKSCAISLAKLGMNVIITGRREHLLNELKNELEKNYSVKVLPLQLDVRNAQEVAEKIANLPTEWKDIDILINNAGLAYGLDKLYLNSSEDISTVIDTNIKGLLYVTNAIVPHMIERDVPTTIINMGSVAGDAAYAGGAVYCATKAAVKILSDGLRIDLVDTKIKVTDVKPGLVETDFSLVRFKGDVERAKKVYQGIEPLTPDDIAETVAYIANLPANVHVAEITLVCNNQADGRTIYKK

SEQ ID NO: 523 - protein, 249 aa, Artificial Sequence
  Synthetic
MGGLKGKTALITGCNRGIGRAIMQELVAGGANIIACTRKQTAEQDAFYRQCQSEYGIQIYPIYFDLSDEDAIRIALKEIYSLKIVIDILVNNAGILNTDGLLRLKMEDAHRVMQVNYFAPLQITQGIVKLMLRSKSASIINVASIAALKPTVGNTVYGASKAALISMTTCWAKELASAKIRVNAVAPGYLDTDMSTSVDSKVMGQLVNDTSLKRLGTVEEVAKVVSFLASDDSSYIDGEVIKITGGYRI

SEQ ID NO: 524 - protein, 244 aa, Artificial Sequence
  Synthetic
LHQTVLITGASRGIGRAAALRFAKAGWRVGAGYRASEVEARRLIAELAELGMMAAAVRGDVADAAEASRLVREARAALGHIDVLINNAGIAYTALFPDTDYAAWRRLFAVNVDGAYHCTQAVLPDMLSRQSGVILNVSSIWGLVGASCEVGYSASKAALIGFTKALAKELGPSGIRVNCVAPGVINTDMNAALDAPTRAMLAEETPLCRLGTPEEVAEVLFFLASDAASFLTGQVLSPNGGIVV

SEQ ID NO: 525 - protein, 281 aa, Artificial Sequence
  Synthetic
MQNQRLQYERIIITGASSGFGKAFARTLASCTGELVLVARNEEALQQLAAELEEKHPGLRAAALPCDLADESALDNLAGRLLELPAAKTLLINNAGAGDYGEFSEGSWDRIRTLLRLNVESLTRLCHAMIPGLKRNGGDIINISSLAALLPIPDFAVYAATKAYVSSLSEALRLELKEHGIRVLAVCPGPVSTGFGKAARRPGFTGNMMPGRNAFDTPTATVVNDSLRALCRGRARVFPGMKIRLAALLLNAAPLGLIRFFMGRRPRKVQPSPTETLPPAP

SEQ ID NO: 526 - protein, 260 aa, Artificial Sequence
  Synthetic
MTNNEIRYTLITGASTGIGYELAKLFARDRHNLILVARNKIKLESVKTELSKYNVDIKILALDLSKSEGIKNIFNYVEINKLSIDILVNNAGIGTFGDFNDIEWKKEEELIDINIKALTQLTKYFLPKILEYKSSGILNVASTAAFCSGPRMATYYASKAYVLNLTEAIYEEYKNTGIKIACLCPGPVKTSFQVKAGIKKSDAAKKYLMDAEEVARICYKDFNKGKLIIIPGKKNRLLVKGNKFLPRSISRRIVLKTNRK

SEQ ID NO: 527 - protein, 249 aa, Artificial Sequence
  Synthetic
MINLTGQVAVVTGGSRGIGKEIAKKLASFGADVVINYTSKEDEALKTKNEIESMGVKCTSIKCDVSKFDEVNQMIDSVVSEFGKIDILVNNAGITKDGLLMRMKEEDFDRVIDINLKGVFNCTKAVTKPMMKKKYGRIINMTSVVGIMGNAGQTNYCASKAGVIGFTKASARELASRNININAVAPGFIETDMTKVLSDDVKESTLANIPKKSYGKPEDVANAVAFLVSDMSSYITGQVINVDGGMVMQ

SEQ ID NO: 528 - protein, 244 aa, Artificial Sequence
  Synthetic
MEIKDKNVFVTGSTRGIGLAIARQFAGLGANIVLNGRSEISQDLIDSFKDYHVKVIAISGDVSNFDDAKRMVDEAINELGSVDVLVNNAGITNDKLMLKMSEADFESVLKVNLTGAFNMTQSVLKPMTRARQGAIINLSSVVGLTGNVGQANYAASKAGLIGFTKSVAREVAARGVRVNAIAPGFIESDMTDAIPEKMQEAILAGIPMKRIGKAEEVASIASFLAQQDYLTGQVIAIDGGMTMQ

SEQ ID NO: 529 - protein, 281 aa, Artificial Sequence
  Synthetic
MMESYIKENYIKDKVIIITGAATGFGKLVAERTAAMGGKIVCCDRKEEELKKTVEGIRDLGGEIEYRIADMTKKDEVDAVAKLAVEKYGRIDILLNNAGTMPLSFFSDHKRAWKAWDDCIDTNIKGVVYGISAVYDQMIKQEKGHIINISSIYSNHPVIGGCVYQASKVAVKYISDTLRQEAYGKIKVTCVKPTGVPTTPLFDCIINQDTAIGLVGQNALAMMGLLQEMPGRPDLTEQDSIRNVYIDPSVLADNVVYVMNQPWGINISDITVRSAGEPYIM

SEQ ID NO: 530 - protein, 253 aa, Artificial Sequence
  Synthetic
MKLKGKVAIITGATAGIGKSIAYLFAEEGASTILIARRKERLEQITNEINSNGGDASACIGDVTKQEDIDNVVKLALDKYGKIDIIVNNAGIMDDFVSVKHIDDDLWDKTIDVNLTGPMRLIRAVIPEMIKNNGGNIITISSVGGLIGKISGAAYTASKHGVIGLAKHTAWVYGKHNIRSNVIAPGTVNTEIATTINPGRMDMETYETIDPFVKLSPKLGQSKEIAQIALFLASDDSSFVNGDVIKADGGWLS

SEQ ID NO: 531 - protein, 249 aa, Artificial Sequence
  Synthetic
MLTNKTALVTGASRGIGAAIAKSLAKEGAFVIINYNGSKERADAVAAEITADGGKAAVYGCNVSDYSACEKMAKDIMETYGHLDILVNNAGITRDDLLMKMSEEAFDAVIATNLKGTFNTIRHFSRYLLKQRSGTIINLSSVSGILGNAGQANYSASKAGVIGLTKSVARELSSRGITCNAVAPGFIDTEMTAQMTDKAKEAVKTQIPLGRVGKVDDIAEVVTFLASEKASYITGQVISVDGGMRAYKQ

SEQ ID NO: 532 - protein, 244 aa, Artificial Sequence
  Synthetic
MSFEGKIALVTGASRGIGRAIAETLVARGAKVIGTATSESGAQAISDYLGANGKGLMLNVTDPASIESVLGNIRAEFGEVDILVNNAGITRDNLLMRMKDDEWNDILETNLSSVFRLSKAVMRAMMKKRHGRIITIGSVVGTMGNAGQANYAAAKAGLIGFSKSLAREVASRGITVNVVAPGFIETDMTRALTDEQRAGTLAAVPAGRLGSPNEIASAVAFLASDEASYITGETLHVNGGMYMV

SEQ ID NO: 533 - protein, 280 aa, Artificial Sequence
  Synthetic
MSSTRVIRGKKKGRKTMVNFSLEGKVALVTGASYGIGFAIASAYAQAGATIVFNDIKQELVDKGLAAYEELGIKAHGYVCDVTDEEQVNALVAKIEKEVGVIDILVNNAGIIKRIPMCEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREIQPDGSRHPFDQFIIAKTPAARWGSAEDLQGPAVFLASDASDFVNGHVLYVDGGILAYIGKQPQ

SEQ ID NO: 534 - protein, 260 aa, Artificial Sequence
  Synthetic
MKLEEFKGKSVVVTGAGAGMGKAITQGFLENGATVIGVDIKEEALSAFKEELKKSDVETAERFIPLTGDISKEATNEAMIQKALDVTGKIDILVNNAGVAGHSEPVTETTNEDWDRILRVNLDGPMYAIRAAVRQMLRQENGGSIVTIASVAGIKGCRSCAAYSAAKHGLVGLCEHTAYTYMHQGIRSNIVCPGAIRTGMTSNPELENSFGRERIMSGMDSQFVFGETTDIKEAVLFLAGERAKFINGATLVVDGGISCN

SEQ ID NO: 535 - protein, 249 aa, Artificial Sequence
  Synthetic
MIIMVTGATAGFGESITRRFVANGHKVIATGRREERLKTLKDELGDNLYIAQLDVRNRAAIETLIADLPAEWQAIDVLVNNAGLALGLEPAHRASVEDWEDMIDTNNKGLVYMTRAVLPGMVARNRGHIINIGSTAGCWPYAGGNVYGATKAFVRQFSLNLRTDLHGTAVRVTDIEPGLVGGTEFSNVRFKGDDAKAGKTYENTEALTPEDVTEAVWWVATLPKHVNINTLEMMPVSQSFAGLSVHRQG

SEQ ID NO: 536 - protein, 244 aa, Artificial Sequence
  Synthetic
VKEVVLVTGATSGIGREIVKILAPFYEVLIHYNQNYVEALKLKEQLETTYHRKFLIFKCDLSSEKEIDLMLERIYNEYPKIDILINNAGIAIDTLFEDKSKENFMKTLEINTIAPFLLSKKIGLEMRKNQYGIIINISSTNGIDTLYPESIDYDASKAGLISLTTNLANYLAPYVRVNTICPGWIKTDMNKNLSSEFIANERKKILLARFGEPKEVAEVVKFLISAKASYINNSIIRVDGGKKC

SEQ ID NO: 537 - protein, 280 aa, Artificial Sequence
  Synthetic
MPIQEKPWRTTALSRFHFKLAGTVKNGFTVGSMQKLAGKTAIVTGAGRGIGNAIARRFASEGARVILISRSPSSCGGAAEEINKEFPDSCKAYPCDVADYAAVQETVSAILKDFPQIDILVNNAGITRDSLMLRMKEEDWDAVMDTNLKSAFNTVKALQRVLMKSPAGRIINMSSVIGLVGNIGQANYAASKAGLIGFTKSLALEFAPRKVTCNAIAPGFISTEMSNAIPDNLKEEIVKKIPLKEQGSVEDIAALTAFLASDDARYITGQVIACDGGMTM

SEQ ID NO: 538 - protein, 260 aa, Artificial Sequence
  Synthetic
MTRCMIGALKGKAAVITGGGSGIGKSMVERYLAEGASVVAADINEASLKALLEELEPEYGDKLKILKVNVSSKEEVEAMIDYTVEAFGKVDVVINNAGILDNLLPIAEMPDDVWERIMNINLNSVMYACRKAVQYFLKEKREGTIINTASLSGLCAGRGGLAYTTSKFAVVGLTKNVAFMYSDAGIRCNALCPGAIESNIGSGMREPSKLGLTKAVTGNSGRHRNGSADEVATAAVFLASDAASFINGETLTIDGGWSAY

SEQ ID NO: 539 - protein, 249 aa, Artificial Sequence
  Synthetic
MIIMFNEKVVLVTGGTRGIGYTTVEEFLKEGARVILFGSREESVTKAINSLKEENNEYKVEGYFTDLANLEEMEKVAKEIATKYGKIDILVNNAGVSSSTPITSYTEEECDKIINLNIKGVFDTSKAVIPYMTGDNPSIVNVSSMVSFYGQSSGCLYPTSKFAVNGLTKSLARELGKKKIRVNAVAPGITNTDMVKNLPDEMIKPLIAMIPLGRIGDPKDIANAILFLASDKASYVTGTILQVDGAMMC

SEQ ID NO: 540 - protein, 244 aa, Artificial Sequence
  Synthetic
MSFEGKIALVTGASRGIGRAIAETLVARGAKVIGTATSESGAQAISDYLGANGKGMLLNVTDPASIESVLGNIRAEFGEVDILVNNAGITRDNLLMRMKDDEWNDIIETNLSSVFRLSKAVMRAMMKKRHGRIITIGSVVGTMGNAGQANYAAAKAGLIGFSKSLAREVASRGITVNVVAPGFIETDMTRALSEDQRAGILAQVPAGRLGDAKEIASAVAFLASDEAGYISGETLHVNGGMYMV

SEQ ID NO: 541 - protein, 280 aa, Artificial Sequence
  Synthetic
MSAEIWLITGASRGFGREFARYALEKGCKVAATARKPEAVTAALGEHENLFPVALDVTKQDQIDAAVECVIKHFGRIDVLLNNAGYGIFGALEEVSDAEVRALFDTNFFGAMSLTRTVLPYMRAQKSGRLVFMGSMASFSCDPGGSAYDATKFAVAAMSEALSLEMKPFGIESMVVEPGMFRTDFFDGTSIRTPEHTIAAYDNTPARGAMNYCLSHNHQQYGDPRKAAALLYDVVSSEEPMPLWLPVGRDAVKKYERKFAQMVEAIQPYRDRMRDCSFDQ

SEQ ID NO: 542 - protein, 260 aa, Artificial Sequence
  Synthetic
MINYDFRGKNVIVTGASMGLGYAIALEFVKAGASLIIADINLEEAEKAKEKLSQYGTRIETYKIDVSNYDEFLSLANYVENTFGSIDILVNNAGIFVAEMFNDMEIAKMDKLINVNLNGTVYGCRAVLPVMKKQQYGKVINISSIAAKLGGSGAAIYSATKAAVLELTACLAREYAKDNININCVLPGIIRTPLWEKALDEMTKGDISKKDTVFAQFTKDIPMGRPQKPVDIAKAVLFLCSEEASNITAQNLAVDGGHTY

SEQ ID NO: 543 - protein, 249 aa, Artificial Sequence
  Synthetic
MSQTMEGKVAVVTGASRGIGKAIAVKLASKGATVVINYNGSRERAEEVKNEVESAGGKAVIIQCNVADFDACKEFIETVIKEQGRIDILVNNAGITKDGLLMKMSEEDFDKVLDTNLKGTFHTIRAALRQMIRQRSGRIINMASVVGVSGNAGQANYAASKAGVIGLTKTAAREVASRGITVNAVAPGFIETEMTAVLSEEVKKASAAQIPLGHFGRPEDIAKAVAFLASDDAAYITGQVIQVDGGMVI

SEQ ID NO: 544 - protein, 244 aa, Artificial Sequence
  Synthetic
MGFDGKIALVTGASRGIGRAIAEKLIACGATVIGTATSENGAKAISEYLGNKGKGFVLNVTETDSIEKFLADVRAEFGEIDILVNNAGITRDNLLMRMKDDEWQDIIDTNLSSVFRLSKAVMRAMMKKRYGRIITIGSVVGTMGNAGQANYAAAKAGVIGFSKSLAREVASRGITVNVVAPGFIETDMTRALTEDQRAGILSQVPANRLGDAKEIASAVAFLASDEAGYITGETLHVNGGMYMV

SEQ ID NO: 545 - protein, 279 aa, Artificial Sequence
  Synthetic
MKEFKDKVLVVTGGSRGIGKAIAVEGAKRGMKIVLNDIDGDQLAKTCAEIKDMGVECISQHADISIYENIEALLKLAMDNYGHVDMLVNNAGCAVSGAIWKLPKQDIDWITELNFLSHLYGMKIFLPQMIAQNTPCEIINVESTAGLMTSGKATMYHATKAAGVAASESVYIAMKEQGYPINIHCLVPAYVKTTIHLADLHRPERFAMNDDPYYTSDEYKAGQIRGERGVMSGIPDWYVGECVFTAVEDEKFYIFTHPESQVVAQPRVQRLASGINPQT

SEQ ID NO: 546 - protein, 260 aa, Artificial Sequence
  Synthetic
MCNENRLKGKLALITGATSGIGKSCAEKLAEMGVDLILTGRRNEVLNEIKVEIEKKYGVKVLPVQLDARNSKEVAEKIAALEGEWKNIDILVNNAGLALGMEKVYSNSAEDIDAVIDTNVKGMLYMIREVVPGMVERDKPSLVINMGSVAGDAAYAGGAVYCASKAAVKTLSDGLRIDLVDTKVKVTNIKPGLVETNFSVIRFKGDKDKAEKVYKGIEALTPDDIADTVTYICNLPDNVQIPEIVMTPMFQADGRTVYKK

SEQ ID NO: 547 - protein, 249 aa, Artificial Sequence
  Synthetic
MNHSVPSMNTSLNGKVAAITGAASGIGLECAKTLLAAGAKVVLIDREGEKLKKIVAELGDNAFALQIDLFNTGQVDNLLAGIIELAGGLDIFHANAGAYIGGPVAEGDPDVWDRVLNLNINAAFRCVRAVLPHMIAQKSGDIIFTSSIAGVVPVIWEPIYTASKFAVQAFVHTTRRQVSEHGVRVGAVLPGPVVTALLDDWPQAKMEEALANGSLMQPIEVAESVLFMVTRSKNVTVRDLVILPNSVDL

SEQ ID NO: 548 - protein, 244 aa, Artificial Sequence; identical to SEQ ID NO: 368
  Synthetic

SEQ ID NO: 549 - protein, 279 aa, Artificial Sequence
  Synthetic
MDYLNDMFSLKGNVALVTGGSYGIGFAIAKALARAGAVIAFNCRSQEHLDQAMKDYKREGIDAHGYICDVTDEIHVQQLVSEIEKTLGTIDILVNNAGIIKRIPMCDMTTEEFRQVVDIDLVGPFIVSKAVIPGMIKKGHGKIINICSMMSELGRETVSAYAAAKGGLKMLTRNICSEFGGANIQCNGIGPGYIATPQTAPLREKQPDGSRHPFDQFIVSKTPAGRWGTTEDLEGPAVVVSRFFRKFISSASKYRNQIYGFSSSFGCSISILNRCSISI

SEQ ID NO: 550 - protein, 260 aa, Artificial Sequence
  Synthetic
MNCNLFYAIIPIKESDFMAKKVVLVTGASRGIGKAIAVKFAKKGYNVVISCAHREAELMQAKKEIEGYQVSCLAFLGDMGDMSTCETMFQQIKKQFGTLDVLVNNAGISYIGLLQDMTSDDWDRIVRTNLTSVFNCCKLAIPMMLSAEKGKIINISSVWGNVGASCEVAYSATKGGINAFTKALAKELAPSNIQVNAVACGAIDTEMNQWLEEDELIQLVEEIPAGRLGQAEEVADFVYHLGYKGTYLTGQIISMDGGWT

SEQ ID NO: 551 - protein, 249 aa, Artificial Sequence
  Synthetic
MEQFNPFSLSGKQILVTGASSGIGRGIALACAKMGATVIITGRNVERLNETLSQMPEGTHKAISADLTKAEDIEALATELPKLDGFVQCAGVGSRVACKDIDQSVIDHTMNPNFEAPVLLQAALLKKKKINKAASIVYIASIAAWSPSMGNGIYSASKGAIISYAQCLAQELAPRLIRVNCICPAMVWTDLVLQDGITREDLQEDEKRYPLKRYGTPEDIANLCIYLLSDASAWMTGSNIKISGGVIKL

SEQ ID NO: 552 - protein, 244 aa, Artificial Sequence
  Synthetic
LHKTVFITGASRGIGRATALRFAMDGWRVGIGYHTSDAEARALIAALAELGTMATAVRGDVASAEDAGRMVQETRTALGHIDVLINNAGIAHTALFTDTDYAAWRRLFTVNVDGAYHCTEAVLPDMISRRSGVILNVSSIWGLVGASCEVAYSASKAALIGFTKALAKEVGPSGIRVNCIAPGVIDTDMNAALNHEARAELAEQTPLCRLGSAEEVAEVLLFLASDAASFITGQVLSPNGGLVV

SEQ ID NO: 553 - protein, 279 aa, Artificial Sequence
  Synthetic
MKEFKDKVLVVTGGSRGIGKAIAVEGAKRGMKIVLNDIDGDQLAKTCEEIKGMGVECIGQHADISLYENIEALLKLAMDSFGHVDMLVNNAGCAVSGAIWKLPKQDIDWITELNFLSHLYGMKIFLPQMIAQGTPCEIVNVESTAGLMTSGKATMYHATKAAGVAASESVYIAMKEQGYPIHIHCLVPAYVKTTIHLADLHRPERFAMNDDPYYTSDEYKAGQIRGERGVMSGIPDWYVGECVFTAVEDEKFYIFTHPESQVVAQPRVQRLASGINPQT

SEQ ID NO: 554 - protein, 260 aa, Artificial Sequence
  Synthetic
MFSTNRVKGKIALITGATSGIGKSCAIALAKLGMNLIITGRRENLLIELKKELEEKFSVQVLAIQLDVRNADEVKDKLFSLSDEWKNIDILINNAGLAAGLDKLYHNSTEDISNVIDTNIKGLLYVTNAIVPHMIERDVPATIINIGSVAGDAAYAGGAVYCASKAAVKILSDGLRIDLVDTKIKVTDVKPGLVETNFSLVRFKGDEERAKKVYQGVEPLTPDDVAETVAYIANLPDNVHIAEITLLCNNQADGRTIYKK

SEQ ID NO: 555 - protein, 249 aa, Artificial Sequence
  Synthetic
MNHSVSSMNTSLNGKVAAVTGAASGIGLECARTLLAAGAKVVLIDREGEKLTKIVAELGENAFALQVDLMQADQVDNILAGILNLTGRLDIFHANAGAYIGGPVAEGDPDVWDRVLHLNTNAAFRCVRSVLPHMIAQKSGDIIFTSSIAGVVPVIWEPIYTASKFAVQAFVHTTRRQVSQHGVRVGAVLPGPVVTALLDDWPKEKMEEALANGSLMQPIEVAESVLFMVTRSKNVTVRDLVILPNSVDL

SEQ ID NO: 556 - protein, 244 aa, Artificial Sequence
  Synthetic
MKKKCALITGASGGIGSSIALRLARDGFAVAACYRSDEAGIASLAAELDVIGAEYKIYRADVADYSQMNTVFADATEEFGGVSVLVNNAGVAQQKLFTDITEEEFDFITGVNFKGVFNCCKCAVPFMVNQKSGKIINISSMWGVYGASCETVYSATKAAVIGLTKALARELAPSNIQVNCVAPGAIDTKMNSNLSSDERAALADEIPMGRFGLPGEIAGVVSFLAGSDSDYVTAQVITADGGMT

SEQ ID NO: 557 - protein, 279 aa, Artificial Sequence; identical to SEQ ID NO: 9
  Synthetic

SEQ ID NO: 558 - protein, 260 aa, Artificial Sequence
  Synthetic
MESRLTGKVVLITGATAGIGRSTAFGFAKMGCKLILLVRNAEKGEALKKEIQAEYDVEIKLLIVDVRDAKGIEAAILGLPEEWKKISILVNNAGLAFGLDKVYTAEIDDIDTVIDTNIKGMLYVTRVVVPLMLEYKMEGHVINLGSIAAVSAYPGGAIYCATKAAIKLLSDGLRIDLVDTPIKVTNIQPGVVETGFSLVRFKGDAERAAAVYRGIESLTPDDVADTIVYAANIPHNVQLTEITMTPCHQADGRCIYKETK

SEQ ID NO: 559 - protein, 249 aa, Artificial Sequence
  Synthetic
MLRKRFENKIVLITGGANGLGRGMAEQYLKEGAKLAIFDIEDDTMEQVYGGMEGVFCLHCDVRSYDEVQASVKRVIEHYGHIDILMNNAGIVHRASFLECSQEGWLDVMATNLNGCFYVGQAVARTMVEKGIKGNIVNTGSNSARKTMTNITPYGASKAAVSMLTQVMALELAQYGIHVNAVAPGTTKTRIAAGTFNDPVRSANFLKKMPFGRYGEIQEMVNVALFLASDDASFITGETIYEEGGFSLP

SEQ ID NO: 560 - protein, 244 aa, Artificial Sequence
  Synthetic
MEKIALVTGASRGIGRAVAAELAHRGWAVAIGYRVRRDKAEELAAALTAEGCRAMVCRADVSRREEVEEMVRRVADTFGPVSLLVNNAGIAGQCLFQDLTDERWHEFFSVNVDGAFYTSRAVLPVMLHEHEGCIVNISSIWGQRGASCEVAYSATKAAIIGLTRSLAAELAPSHIRVNCVAPGVIRTDMLNELPPELLPELAQQTPMGRLGRPEDIAAAVAFLADPAADFITGQVLTCDGGFIL

SEQ ID NO: 561 - protein, 279 aa, Artificial Sequence
  Synthetic
MKEFKDKVLVITGGSRGIGKAIAVEGAKRGMKIVLNDIDGDQLAKTCEEIKGMGVECVGQHADISLYENIEALLKLAMDSFGHVDMLVNNAGCAVSGAIWKLPKQDIDWITELNFLSHLYGMKVFLPQMIAQGTPCEIINVESTAGLMTSGKATMYHATKAAGVAASESVYIAMKEHGYPINIHCLVPAYVKTTIHLADLHRPERFAMNDDPYYTSEEYKAGQIRSERGVMSGIPDWYVGECVFTAVEDEKFYIFTHPESQVVAQPRVQRLASGINPKT

SEQ ID NO: 562 - protein, 260 aa, Artificial Sequence
  Synthetic
MYKENISGRLAFISGASAGIGEAVAKMLASNGVNLILTARRIDRLENLKNSLEKEYKIKVKTIKIDFSKSEDIVKALNSLEDEWKNIDILINNAGLALNKDVYSNNLLEDALQMIRVNCEGLITATRVLLPFILKSKCGHIINIASTAADEAYSGGAIYCATKSFVEMFGDAIRIELIDKPVKVTTIKPGLVDTEFSTVRFKGDKEKADNVYKGLNPLYAEDIADNIEYVITRKSHVQISSMTIMAESQGTATIAYRKNI

SEQ ID NO: 563 - protein, 249 aa, Artificial Sequence
  Synthetic
MNKRFNHKVALVTGGENGIGKAIAERLANEGAKVFVVDLHEEHLKKAFGKNENIAYMVADLTCEANIGKIINEIKARYSKLDVLVNNAGLAPVCPIKDMALSQADLTFGVNVRALIHLSKEAYPLLKESKGNIVNISSTMVSKPLPNMSVYAAAKAAVHALTRSWAKEWALDGIRVNTVALGPIKTPIYGKTDLSAEDAQKHIEVVKKTVPMGRFGEPEEVASVVAFVASYEASFVTGADFVVDGGVAA

SEQ ID NO: 564 - protein, 244 aa, Artificial Sequence
  Synthetic
MEKKIIIVTGASRGIGKEIAKTLAKEGHTVIANYNKSEKEAQKLKEELKKENKEIEIYKADISKEEEIKKMVEYTIKKYKKIDILINNAGIDKIQLSTEVTKKDWDEIINTNLYGTFYITQQVTKNMIQNKKGKIINISSIWGQIGASMEVVYSISKAGVDGLTKALAKELGPSGIQVNSIAPGFIKTEMNAGYNKKELEEIKDEIPLQKLGECEDIARCIKWLIEDKYVTGQIIAINGGWSIT

SEQ ID NO: 565 - protein, 279 aa, Artificial Sequence
  Synthetic
MNDKAKDTEEVAVAPLRRVAIVTGASRGIGAAIAQRLALEGYSVVLNYASDGSTEAARALCAELSDFAATEVQESLALEVEEAAEPQRFIALQADVSHFDEAKQLINEVKQQFGRIDVLVNNAGITRDGLLARMKEEAFDRVIEVNLKGAFNCLRHAAPLMMKQRYGRIISVSSVVGIAGNAGQVNYAASKAGIIGMTKAAAKELASRGITVNAVAPGFIDTAMTDVLSDAAKETILSRIASGVFGAPEDVANAVAFFAQPESEYITGQVLCIDGGMSL

SEQ ID NO: 566 - protein, 260 aa, Artificial Sequence
  Synthetic
MLEKNNQSTKLKEEYMLFKDKVVMVTGSSGGIGKATAIAFAKEGADIYLHYNNSESECIKVAKEIKGSGGNCYLVKADLTSMNDIKKMFTYVRQTTNWLDILVNNAGILKKSYIKSMSEELWEEVMNTNLKSAFFCAKYAFPLLIKAGGNIVNVASLSSLRPIIGESCYGAAKAGLVSLTRSMALEYGRFNVNVNAVSPGPVNTSMREIRSVELEKLIKKIPLGRISKVDDIANAILFLCSEQSSCITGQILNVDGGLSI

SEQ ID NO: 567 - protein, 249 aa, Artificial Sequence
  Synthetic
MERKIVIVTGASRGIGNGIATALAADGFTLVCVQQSENEEYMKAIRALSPESVCIRADISKADDEARIIDTAIERFGKIDILVNNAGVAPKEREDILNMSRESMDRLLDINLKGTFFLTQYCANKMTELGFGEAIINITSMSAYTSSTSRSEYCISKAGLSMVTTLFADRLAEYGINVYEVRPGIIKTDMTATVNEKYDRLIGEGLLPIKRWGYPEDIGRAVVALAKGYLPYSTGEVINIDGGFHIRRL

SEQ ID NO: 568 - protein, 244 aa, Artificial Sequence
  Synthetic
MNKVVLITGGSSGIGKETVYKFAKNGYDIIFTYNKSKEMSKTIEKDIISSYNVNIYSIKCDISLENDVKSLSNFVKEKTKKIDVLVNNAGIAIDNLFEEKTVEEFKKVIDTNLVGTFSVIKYLGNLINDGGSIINISSTNAIDSYYIESIDYDASKIGIISLAHNLAKYYAPRIRVNCICPGWVDTLMNKDLSKEQKDRENKKILLNRFAKPSEIANVIYFIASDEGSYINDAIIKVDGGRNND

SEQ ID NO: 569 - protein, 279 aa, Artificial Sequence; identical to SEQ ID NO: 8
  Synthetic

SEQ ID NO: 570 - protein, 260 aa, Artificial Sequence
  Synthetic
MNKTFVITGGTKGIGRCMVENFASKGDKVYFIDNDAKTTIVVGNQLRSKGWDVHDFVGDIADKQTLIDFAAKVLQENPDGIHCLINNACLMHGGILDGCEYENFLYIQQVGVVAPFMLSKLFKDHFCGVGAIVNISSTRAFQSQPNTESYSAAKGGITALTHAMAVSLSGIARVNAIAPGWIDTGKYHDENYQPAYTEGDEKQHPSGRVGEPMDIVRAAEFLCDERNSFINGQCITIDGGMSKLMVYHNDCGWTLSPNNK

SEQ ID NO: 571 - protein, 249 aa, Artificial Sequence
  Synthetic
MDLNLKGKTALITGASRGIGKKIAETLAKEGANIVITATNIEKASTVADELKSQYNIETMALKHNVKLSESCKEIVDKTVEKFKSIDILVNNAGIARDMLVIQMDDNAWNEVIGTNLSGAFYTSREAAKYMLKARSGKIINISSVIGKMGNAGQTNYAAAKAGIIGITKSMAKEFASRKICVNAIAPGFIQTDMTGVLPEDTVKNIMNITPLKRLGNAEDVANLVAFLSSDLSDYITGEVIAVDGGMSM

SEQ ID NO: 572 - protein, 244 aa, Artificial Sequence
  Synthetic
MSFEGKIALVTGASRGIGRAIAEKLAARGATVIGTATSESGAAAISEYLGAKGKGLALNVTDSASIDHVLENIRAEFGEIDILVNNAGITRDNLLMRMKDDEWQDILDTNLSSVFRLSKAVMRAMMKKRCGRIITIGSVVGTMGNAGQANYAAAKAGLIGFSKSLAREVASRGITVNVVAPGFIETDMTRALTDDQRAGILSQVPANRLGDAEEIASAVAFLASDEAAYITGETLHVNGGMYMI

SEQ ID NO: 573 - protein, 279 aa, Artificial Sequence; identical to SEQ ID NO: 10
  Synthetic

SEQ ID NO: 574 - protein, 260 aa, Artificial Sequence
  Synthetic
MIKYDFSGKNVIVTGASMGLGKAIALEFVKAKANVVIADLNIETANQTKEELSKYGTKVLAYQVDVSKANDFQNLVSAIENQWGRIDVLVNNAGICKSLPLIEMEDEDIDRMIKINLNGTVYGCKAVLPVMQKQHYGKIINMSSVAAKLGGANASVYSITKAGVLELTACLAREYAKDNININCVLPGIIRTPLWENMLNELTVGHEDQKDEVFTSFTKDIPLGRPQEAKDIANAVLFLASDDSNNITAQNLGVDGGQTY

SEQ ID NO: 575 - protein, 249 aa, Artificial Sequence
  Synthetic
MIIMVTGATAGFGESITRRFVANGHKVIATGRREERLKTLKDDLGDNLYIAQLDVRNRAAIETLIADLPAEWQAIDVLVNNAGLALGLEPAHRASVEDWEDMIDTNNKGLVYMTRAVLPGMVERNRGHIINIGSTAGSWPYAGGNVYGATKAFVRQFSLNLRTDLHGTAVRVTDIEPGLVGGTEFSNVRFKGDDAKAGKTYENTEALTPEDVTEAVWWVATLPKHVNINTLEMMPVSQSFAGLSVHRQG

SEQ ID NO: 576 - protein, 244 aa, Artificial Sequence
  Synthetic
MKFENKVVIVTGASSGIGEGVARMFLEEGACLVGCGIEPKMNIESEKAIYVQADLTDPAQAQNVVDKAVEAFGQVDKLVCCAGVTFIGSLETTSYDSFLREISINLGGVFNMCKAAVKELVKSQNPSIVTIGSDLGVRPIPERIGYCPSKAGVIMLTKCIALEYAPKVRVNCVLPGLVRTPMTEQRFQEAEDPAALEEEYASLYPLHKMGKVADMANAVRFLSCSEDSGFITGEIMNVCGGSLI

SEQ ID NO: 577 - protein, 279 aa, Artificial Sequence
  Synthetic
MTKKTWLITGVSSGFGRAMTAQLLAAGNTVIGTVRNTAKVQDLIDQYPDTFICEILDVMDVPAIHELVNRVATEHSIDVLVNNAGYGLFGAAEELSDADIDKILATDLTGSIQMIRSVLPFMRKQQHGQIIQISSYGGQVAFAGNSMYHAAKFGIEGFCESVAQEVEPFNIGMTIVEPGGARTEFRYGSAHVANLMKEYDENPAHAFMKMLDPANGLAPGDPARMAARIIESVDQPDTPLHMVLGSQALASTIATIEKRLAEYQTEKELAASTDFPAGE

SEQ ID NO: 578 - protein, 260 aa, Artificial Sequence
  Synthetic
MPEARHNPVLAGQTAVITGGASGIGKSIVQRFLEAGANCLAADLNGEALDALKEEFAEYGDKLDTVKVDVSNRDDVESMVDRAVQTFGQMDIIVNNAGIMDNLLPIAEMDDDVWERLMKVNLNSVMYGTRKAVRYYMERGEGGVIINTASLSGLCAGRGGCAYTASKFAVVGLTKNVAFMYADTGIRCNAICPGNTQTNIGVGMRQPSERGMAKATTGYAGATRSGTPEEISAAAVFLASDQAGFINGETLTIDGGWSAY

SEQ ID NO: 579 - protein, 249 aa, Artificial Sequence
  Synthetic
MIILVTGATAGFGESITRRFIANGHKVIATGRREERLKTLKEELGDNLYTAQLDVRNRAAIEEMIAGLPADWQSIDVLVNNAGLALGLEPAHRASVEDWEDMIDTNNKGLVYMTRAVLPGMVERNRGHIINIGSTAGSWPYAGGNVYGATKAFVRQFSLNLRTDLHGTAVRVTDIEPGLVGGTEFSNVRFKGDDAKAGKTYENTQALTPEDVTEAVWWVANLPKHVNINTLEMMPVSQSFAGLSVHRQG

SEQ ID NO: 580 - protein, 244 aa, Artificial Sequence
  Synthetic
MLKNKIAIISGGSSGIGLSCVRMMLEKRCTVVSFSRNINSSDLKKLSDKFPNQLYLFECDISIHSQVKQTIKKVIGKFKRIDIVVNNAGIINDSFIQNMTDEQWLSVINVNLNGPFYLLREVIPFMIEQKDGNIVNISSIASERGTIGQSNYSASKSALNGLTRALSKELGKYGIRVNSVIPGIVQTDMISGVPSKILNKNIDMIPLNRIGTPDEIAQAVLFLASDAASYCSGCFLNVDGGLRI

SEQ ID NO: 581 - protein, 278 aa, Artificial Sequence; identical to SEQ ID NO: 7
  Synthetic

SEQ ID NO: 582 - protein, 260 aa, Artificial Sequence
  Synthetic
MELGLTGRTVVITGGSSGIGKAVAWEYLKEGCHVAVCSRGQARLEDAVREFQAAGYSVFARSLDVTDYPAVERFADEVAEAYGKIDVWYNNAASNQTKSLMDYSYDEFRNSTEALLVSVFAGCKIAAAHMRKTGGGVILNASSYSAVIPNAGRAPYSACKSAVSSLTRSFAAELAPDQIRVLAYVPGLIATEITRDHIARNRDALLSAIPCRRFGRPEDLAKVLVFLSSDIAEYMNGTEVYISGGKFCTQNPQYGWEHMV

SEQ ID NO: 583 - protein, 249 aa, Artificial Sequence
  Synthetic
MVISMKTALITGATGGIGGKTAEVLGQAGYEVIVTGIDEAGRDTVMSNLESKGIKAHFYKCDATSEEQVNETFAKIAEKFDHLDLLVNNVGGLGGRQRVSEMETGFMRKVMALNFDSLFFNTRAALPLLKKGTNPSIINFSTIAVTNGGGIGASIYAASKGAVQSYSRALAKDLAEFGIRVNMVSPGTIDTPFHAATDRKLVESWKDSILMKRLGEPREVADVIEFLASDKASFLTGEVIQINGGQAFI

SEQ ID NO: 584 - protein, 244 aa, Artificial Sequence
  Synthetic
MLEGKTVLVTGAAKGIGKAIALAFAKQGCNIVLNYRSNVSDDTIKEIEAYNVKCMPLQGDVSDFATAAEIVKKAKKEFGTVDVLVNNAGITKDMLLMRMSEEEFDSVIQTNLKGTFNMIRHVSSVMLKQRSGAIINMSSVVGVTGNAGQANYAASKAGVIGLTKATAKELAARGVTCNAIAPGFVETDMTAVLTDEQKSMMLEAIPLKRYGQVEDIANAAVFLASDKAAYITGQVLLVDGGMVM

SEQ ID NO: 585 - protein, 278 aa, Artificial Sequence; identical to SEQ ID NO: 15
  Synthetic

SEQ ID NO: 586 - protein, 260 aa, Artificial Sequence
  Synthetic
MRTFNKEYVLITGASSGIGYELAKLYARSGQNLILIARNIDRLKKVESELNKYNVEIKILSLDISKNYDIEKLFNYVEINNLNINTLINNAGIGTFGDFKEIEWEKEEALIDINIKSLTRLTKYFLPKIIGNKNGGILNVASTAAFCSGPRMATYYASKAYVLNLTEAIYEECKDTGIKVSCLCPGPVKTGFQGKAGINKSESAKKYLMDAEEVAKITYKEFNKGKLIIIPGVKNKLLVLGNKFLPESISRKIILKTNKK

SEQ ID NO: 587 - protein, 249 aa, Artificial Sequence
  Synthetic
MIIFVTGATSGFGEAIARRFIREGHQVIAAGRRLERLEELQDELGQALHIVRLDVRNRAAIQQAIEALPAELRQIDVLVNNAGLALGLEPAHKANADDWETMIDTNAKGLVNMTRALLPAMVERNVGHVINIGSTAANWPYAGGNVYGATKAFVKQFSLGLRADLHGTRIRVTDIEPGLVGGTEFSNVRFKGDDGKVNKTYEGADALTPEDIAESVFWVATLPARVNINTLEMMPVSQSFAGLNIHRGA

SEQ ID NO: 588 - protein, 244 aa, Artificial Sequence
  Synthetic
MKTSGNTVFITGGSAGIGLAIAKKLQAAGNKIIINGRNEERLQRALAELKDAEGIQGDLSVEADRRRIAEELKTYYPDVSIIVNNAGAAFGYLLSETTDAHEKALVEMNTNYIAVIHFTELLLPHLLKKSDSAVINISSIAVYGSHKFLPTYGATKAALHSYTVALRMTYEEQKNLQIYEVYPPMVNTEFSAEIGGANGIPASEVADELLVALEQNQFDVPVGETKIYAAAAEQAFANIARSRQ

SEQ ID NO: 589 - protein, 278 aa, Artificial Sequence; identical to SEQ ID NO: 18
  Synthetic

SEQ ID NO: 590 - protein, 260 aa, Artificial Sequence
  Synthetic
MNCNFFYAIIPVKESDFMAKKVVLVTGASRGIGKAIAVKFAKKGYNVVISCAHREAELMQAKKEIEGYQVSCLAFVGDMGDMSTCEAMFQQIKKQFGTLDVLVNNAGISYIGLLQDMTSDDWDRIVRTNLTSVFNCCKLAIPMMLSAEKGKIINISSVWGNVGASCEVAYSATKGGINAFTKALAKELAPSNIQVNAVACGAIDTEMNQWLEEDELIHLVEEIPAGRLGQAEEVADFVYHLGYKGTYLTGQIISMDGGWT

SEQ ID NO: 591 - protein, 249 aa, Artificial Sequence
  Synthetic
MIILITGATAGFGESMTRRFIANGHKVIAAGRREERLKTLQDELGNNLYTAQLDVRNRAAIEEMIAGLPAEWQAIDVLVNNAGLALGLEPAHKASVEDWEDMIDTNNKGLVYMTRAVLPGMVERNRGHIINIGSTAGSWPYSGGNVYGATKAFVRQFSLNLRTDLHGTAIRVTDVEPGLVGGTEFSNVRFKGDDAKAGKAYENTQALTPEDVTEAVWWVANLPAHVNINTLEMMPVSQSFAGLSVHRAG

SEQ ID NO: 592 - protein, 244 aa, Artificial Sequence
  Synthetic
MNKLALITGGTRGIGKQIALTFAKEGYDIAINYRTENDDLKNTKREIEANNVKCFSVQGDVTKFEDCEKFVKQIIEEFGKIDVLVNNAGITRDTLLMRMKEEDFKQVIDTNLVGTFNVTKNVISYMMKARNGRIINISSVVGISGNAGQTNYAASKAGIIGFTKSLAKEVASRNITVNAVAPGFIETQMTAVLKEDIKEEIAKKIPLKRMGTPQDVANVVKFLASSDSSYITGQVIHIDGGMLM

SEQ ID NO: 593 - protein, 278 aa, Artificial Sequence; identical to SEQ ID NO: 17
  Synthetic

SEQ ID NO: 594 - protein, 260 aa, Artificial Sequence
  Synthetic
MKSMDNNYVLITGASSGIGFELAKLFKRDGHNLILVARDKEKLKNATDKLNDKKNKIIMLDIDLSKEEQINKLINYIDDNEIKVNILVNNAGIGSFGNFTEVDWNIEEKLIDINIKALTRLTKYFLPKMIENKSGGILNVASTAAFSSGPRMATYYASKAYVLNLTEAIHEEVRTFGVKISCLCPGPVRTSFQSKAGINKSEKAKKYLMDADIVAKVGYEEFKKGKVIIIPGFKNKILVNANRLLPRAISRKIILKTNKK

SEQ ID NO: 595 - protein, 249 aa, Artificial Sequence
  Synthetic
MEKLLLGKNAIITGCARGMGHKMMEVFAEHGANLWVCARKQTEQFEHDVKDLSEKHQVNIIPIYFELTDGEAMKLAVKQIMSFKQPIDILVNNAGITYNALFQMSTIDQIHHTLEVNFVAPFLFTQYIVKLMLRHGHGSIVNIASSAGQDGNSGRSVYGASKAAVICATQALSEELGNKGIRANVIAPGITQTDMLSSMTDEVIQETVRNTDMKRLGEPLDIANAALFLASDLSSYITGQVLRVDGCLQ

SEQ ID NO: 596 - protein, 244 aa, Artificial Sequence
  Synthetic
MRQVALVTGASRGIGRAIALELGQAGCAVCVNYLNSAQAAQQVVQALHDQGCDAIAVQADVADGEAVAAMVRETERELGPVTVLVNNAGIAGQAQFQDITDDMWNRYLAVNLGGARNTIRAVLPHMLWEKSGAIVNISSIWGLRGASCEVAYACTKAAIIALTRSLAMELAPSGIRVNCVAPGVINTDMVQVLGEETLRDLAEQTPLGRLGTPEDIAHAVAFFASDKAAFITGQVLGADGGFIV

SEQ ID NO: 597 - protein, 278 aa, Artificial Sequence; identical to SEQ ID NO: 19
  Synthetic

SEQ ID NO: 598 - protein, 260 aa, Artificial Sequence
  Synthetic
MVNENRLKGKIAFITGATSGIGRSCAVKLAEFGMNLIIAARRENVLNKLKEKLEKEHKIKVYVMPLDVRDSKAVVEKINGLPEEWKAIDILVNNAGLAFGLDKLYLNSNEDIDTVFDTNVKGMLYVNNAVVPLMLKRDVPCTIINMGSVAGDAAYAGGAVYCASKAAIKTLSDGLRIDLVDTKIKVTDIKPGLVETNFSMIRFKGDKERAEKVYKGIEPLTPDDIADSVAYVANLPANVHIAEMTIVCANQADGRTIYKK

SEQ ID NO: 599 - protein, 249 aa, Artificial Sequence
  Synthetic
MDLLKNKTAVITGAHRGIGKAILEKFCEYGCNCFVINRKEDPVFTEYCENLQKEYSVKIELFYADFSSEDEIKTAVKQIISKKVPIDILVNNVGVAYPQNMFTMTKLATIKNTFEVNLFSSILVTQLISRSMMKNQKGSIVFISSSAAFDGGANIEYSASKAAIVGAMRRMAIELGNFGIRVNSVAPGLTSTDMGNSMSAEDEADAVSRNIMKRKAEPSEIADAVAFLSSDMSRFITGQVLRVDGGLLK

SEQ ID NO: 600 - protein, 244 aa, Artificial Sequence
  Synthetic
MNKVAFITGGTRGIGRQIAITLAENGYNIAVNYRTNNNAIITLKEEVERNNVKFIAVQGDVSKYEDTENMINEIIRQYTRIDVLVNNAGVTKDTLLMRMKKEDFEDVININLVGTFNVTKNVIPYMMKQKNGRIINISSVVGISGNAGQANYAASKAGIIGFTKSLAKEVGSRNILVNAVAPGFIETQMTDVLKEEVKEEISKTIPLKRTGKPIDVANVVKFLASEDSSYITGQVINVDGGMLM

SEQ ID NO: 601 - protein, 278 aa, Artificial Sequence
  Synthetic
MKEFKDKVIVVTGGARGIGKAIAVEGAKRGMNVVLNDIDPLVCETAKEIEAMGVKCVAQNADISIYENIEALLKLTLDTFGHVDILVNNAGCAVSGAIWKLPKRDIDWITELNFLSHLYGMKIFLPQMIAQGTPCEIVNVESTAGLMTSGKATMYHATKAAGVATSESVYIAMKENNYPINVHCLVPAYVKTTIHLADLHRPERFAINDDPYYTSEEYKAGQLRGTRGVMSGIPDWYVGECVFTAIEDEKFYIFTHPESQVVAQPRVQRLASGINPKT

SEQ ID NO: 602 - protein, 259 aa, Artificial Sequence
  Synthetic
MEFNFKGKKAIVTGGGSGLGRECALLFAKGGADVLIADLLPERCDTVAEEIRNLGVNAIAYPIDVCDYSQMEAMYKKALEEWGRVDFVVNSAGVCLTEELTKQSLKDINLSIDVNIKGTVYSCREALKIMRPQKYGKIVNMSSIAAKSCAGGFSVYSATKAAVLALTASLGREAALDNVNVNCICPGIIKTSMWEDILDQIAGQDQETRDKVWAEWNKGTPNGKPQDPIDIAYMTAFLCTDEARYITCQNIGVDGGYTF

SEQ ID NO: 603 - protein, 249 aa, Artificial Sequence
  Synthetic
MDMLKGKVAVVTGGTRGIGYSIVETFLRNGATVVLLGSRQETVDKALASLKEADPAWPVEGFAPKLDDYNAMQELFAQLHEKYGRIDILVNNAGVSARESLYTYDPTDFDRVMDLNVNSVFYACRAVAPIMKAQGGGVILNTSSMVSLYGQAAGAAYPTSKWAINGLTKSLARELGPDGIRVNAVAPGVTRTDMVAALPKEMVDRISAPIPLRRMGEPEEVANAFLFLASDMASYITGAVLSVDGAAMS

SEQ ID NO: 604 - protein, 244 aa, Artificial Sequence
  Synthetic
MKRAALVTGASRGIGRAIAAELAREGWAVCINYLEQREAAEALVRQLREAGHEAIAVGADVADRQAVDAMVCTAASELGPVGLLVNNAGISRQGLFQDTDDETWDRTLAVNLTGARNAAKAVLPHMLSEKRGCIVNISSIWGLRGASCEVAYACSKAAIIGLTRSLALELAPSGIRVNCVAPGCIETDMVRVLGEETRAMLVEETPLGRLGTPEDIAHAVAFFASERAAFLTGQVLTADGGFIV

SEQ ID NO: 605 - protein, 278 aa, Artificial Sequence
  Synthetic
MPNRKISIPSFDMTGKTVIVTGGSQGLGFGIAAAFCAYGANVVITARTVSKVEDAERDLNENYCKGGKCLGIPADSGKQEDIDMVISKTIDTFGELNIFVNNAGISGKTAKILTDECNEANFEHVVDINLKGMFLFDKAAAAQMVKQNAVNGKKGGKIINIASVGGLVGGPGVVAYGASKAGALSLTKTFANELGRENITVTAVCPGYVVTPLNEDVFIDSETGGWSKVYDLSAKNTALRRLGTIEEVAGPVLAMASDSFNYMTGSYLVLDGGQTIGR

SEQ ID NO: 606 - protein, 259 aa, Artificial Sequence
  Synthetic
MYTLITGTTSGIGKEFAELFAKKGYNLVTVAMNEEKLKEQKQTLESKYNISVKYIVKDLSIEESYSEIYNEVKASNIEIDILINNAGFATYGNYIDVEWQKQKNLAMVNMMAVMQLSYMFGKDMAKRKSGRIMNIASIASFEPGPFMTMYYASKAFVRSFSEGLHEELKDQGVIVTAICPGPTKTKFEERASMKKSYMFKKMKVDTAKEVAEKSYKAMMKNKAVYVVGFHNKLIAFATRFGSLKLNRKVAKKINIGTAK

SEQ ID NO: 607 - protein, 249 aa, Artificial Sequence
  Synthetic
MSEVFNPFSLQGKTILVTGASTGIGKSIAISCAKMSATVIITARNEERLNATLAQMPGDHKTVKADLTNSADIESLVASLPKLDGIVHNAGVGSRVPCKMISEENIAEVMRPNFEAPLLLQTALLKDKIINKSASIVFIASRAASVPSMGNAVYSASKGAIVSYARCLALELAPRLIRVNCICPAMVWTELILKGGVTEEVLHKEEQKYPLKRYGKPQDIANLCLYLLSDASIWMTGSAIDITGGSIML

SEQ ID NO: 608 - protein, 244 aa, Artificial Sequence
  Synthetic
MSFEGKVALVTGASRGIGRAIAETLVARGAKVIGTATSENGAQAISEYLGANGKGLMLNVTDPASIESVLENIRAEFGEVDILVNNAGITRDNLLMRMKDDEWNDILETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIASAVAFLASDEASYITGETLHVNGGMYMV

SEQ ID NO: 609 - protein, 278 aa, Artificial Sequence
  Synthetic
MKTWLITGASSGIGYGIAQAAMERGDKAIIAARSEDKLQALADRFPDQAQVLVLDVSDAGSIAQAMTQIADRLDDVDVLVNNAGYGYRAAVEEGEEAEIRKLYDTNVWGPVRLMKAVLPHMRARKQGTIINVSSIAAVRPGVGSGYYSSSKAALERLSDAVSEEVQHLGIHVMIVEPGAFRTAFFDALHGTGTKAPIDDYDATAGKNRVENIVNHHDQRGNPAAAGQCLVDLVHKGCFPGRLALGPDALQYISQELTRRQEELKAWQEISRKTDFPKA

SEQ ID NO: 610 - protein, 259 aa, Artificial Sequence
  Synthetic
MPDHIQPLAVITGASSGIGRELAKLAAQKGYRLLLIARNMRALEVLSRDLRTETHLLALDLTAAGAVDQISSWLSDRQIVPEIFINNAGFGAFGPASDMDEAMLKKMIRLNVMALTSLSLRMARRMKREGRGRIMNVASTAAFQPCPYLGVYGATKSYVLSFTESLAEELKGSGVTVTAFCPGPTRTQFGVTAGLSQESPFDRLSADPERVAETGFKGMMAGRVVVLDGATNRFGAFMTRFLPRCLVRRIAGGMLAKLK

SEQ ID NO: 611 - protein, 249 aa, Artificial Sequence
  Synthetic
MSLKNHTILVTGGSRGIGRAIVLDLARRGANVAFTYQKEDTCAHETEKLARDLSGYITAYRVDSGNGEEIKRFVHSIAARHGTIDGLVNSAGIRMDRTLLYMDDAEWDRVIDIDLTGVYRMTKAVIPYMLKAKKGRIVNISSVSGISGLSGQTNYSAAKAGLHGFTKALAKETASFGIAVNAVAPGPVETEMLKGLSEEYLERLLSNVPVKRLCAPEEVALVVRFLLDDQMSPGYLTGQILSLDGGMGL

SEQ ID NO: 612 - protein, 244 aa, Artificial Sequence
  Synthetic
MELKNKNVFVTGSTRGIGLAVAHKFASLGANVVLNGRSEISEDLLAQFADYGVTVVGISGDISNGEDAKRMVAEAIDKLGSVDVLVNNAGITNDKLMLKMTEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMIAQVPMKRIGQAEEVAEVAAFLASQEYLTGQTIAIDGGMTMQ

SEQ ID NO: 613 - protein, 278 aa, Artificial Sequence; identical to SEQ ID NO: 1
  Synthetic

SEQ ID NO: 614 - protein, 240 aa, Artificial Sequence
  Synthetic
MGKLTGKTALITGASKGIGEGIARTFLKHGAKVILAARGAAVEELAAQMGENAMAVRMDVSDPASVKAGVEAAQAAFGPIDILVSNAGICKLGYFLTQSDEDRDAHLDINVKGAWNTCKAVIPGMLERKWGKIVIMSSVTGDMVADPGEAAYAMSKAALVGLTKALAREFAPTINVNAICPGYVLTPMVKGMAQQSCPDNPQSVIDGIASAIPLGRLADPTEVGELAAFLASDEASYLTG

SEQ ID NO: 615 - protein, 249 aa, Artificial Sequence
  Synthetic
MIILVTGATAGFGESITRRFIANGHKVIATGRREERLKTLKDELGENLYTAQLDVRNRAAIEEMIAGLPADWQAIDVLVNNAGLALGLEPAHKASIEDWEDMIDTNNKGLVYMTRAVLPGMVERNRGHIINIGSVAGAWPYAGGNVYGATKAFVRQFSLNLRTDLHGTALRVTDIEPGLVGGTEFSNVRFKGDDAKAGKAYENTEALTPEDVTEAVWWVANLPKHVNINTLEMMPVSQSFAGLNVHRQG

SEQ ID NO: 616 - protein, 244 aa, Artificial Sequence
  Synthetic
MELKNKNVFVTGSTRGIGLAVAHKFASLGANVVLNGRSEISEDLLAQFADYGVTVVGISGDISNGEDAQRMVAEAIEKLGSVDVLVNNAGITNDKLMLKMTEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMIAQVPMKRIGQAEEVAEVAAFLASQEYLTGQTIAIDGGMTMQ

SEQ ID NO: 617 - protein, 277 aa, Artificial Sequence; identical to SEQ ID NO: 3
  Synthetic

SEQ ID NO: 618 - protein, 259 aa, Artificial Sequence
  Synthetic
MKKYTRKEKCNMKALITGASSGIGRDIARELSKNGYDLILVARNIEKLNEVKSELKTNVEVVSMDISNVENCKKLHEKYKNISILVNNAGFGDCGYFTKTSLEKELQMINTNIVAYHVLTKLYLQDMKEENSGKILNVASIAGFMPGPLMATYYSTKAYVVRLSESIREELRREKSKVQISILCPGPVDTDFNKVADVEFALKGLSSKYVAKYAVKKMFKGKFYIVPGIKIKLAKFASKISETSIVAMVSYNMQRRKIQ

SEQ ID NO: 619 - protein, 249 aa, Artificial Sequence
  Synthetic
MKLNGKTVLITGGSQGLGAAMSRLFAEAGALVFVNCAHHIEKAEAVVSAIRAAGGLASVKRFDISREEEVRKAFSEIERESGGVDILVCNARVDPYKRPPELSDGDWFDTVIGVNLKGPYLCGLAALEQMKKRGGGRIVNISSVWAYRSAKRSMVEYALSKAALHSLTRSLAGLGAAHGVTVNAVAPGMILSDELAGRLTPEEISAMTERIPVKRGAAAEEIFAAVRFVVENPYMTGEILNINGGVYMP

SEQ ID NO: 620 - protein, 244 aa, Artificial Sequence
  Synthetic
MELQNKNVLITGSARGIGLAIAHKFASVGANVILNGLSGISDDILAEFAGYSGKVVAVIGDVSKAADAQRIVEEAVAALGSVDVLVNNAGITRDKLMLKMTEEDFEQVLKVNLTGTFNMTQSVLKPMTKARQGAIINLSSVVGLAGNIGQANYAASKAGLIGFSKSVAREVAARNIRVNCIAPGFIASDMTDVLPEKIKEASLALIPMKRFGTPEEVADVALFLAGQEYLTGQVITIDGGFTMQ

SEQ ID NO: 621 - protein, 277 aa, Artificial Sequence; identical to SEQ ID NO: 24
  Synthetic

SEQ ID NO: 622 - protein, 259 aa, Artificial Sequence
  Synthetic
MALNEKVILVTGAAQGIGRGIALRLAADGADIALVDLKADKLEAVKKEVEALGRKASTFSADVSKRDNVYAAIDHAEKELGGFDVIVNNAGIAQVNPIADVLPEEVDRIFKINIEGVLWGIQAAATKFKARKQKGKIINASSIAGHDGFAMLGVYSATKFAVRALTQAAAKEYASAGITVNAYCPGIVGTDMWVEIDERFSEVTGTPKGETYKKYVDGIALGRAQTPEDVAALVAFLASDDSDYITGQAILTDGGIVYR

SEQ ID NO: 623 - protein, 249 aa, Artificial Sequence
  Synthetic
MDDLLNIAGRVALITGGARGIGAATAKLLALHGADIIILDLKRTDESDRTLRAVQQAGRRALLIEADVSQTEKVAQVCREAEKTMGPVDILVNNAGIARSNTMADITEADWDAVIDVNLKGVYNTCKALVPGMMERGYGRVVNLSSIAGRRGSLFGDVHYSSAKAGVIGFTKCLARIAGPRGVLCNAVAPGIVKTDILSAEHEAQSQANIPLGRTGRAEEIAAAILFLCSPMSSYITGMVMDVNGGSYM

SEQ ID NO: 624 - protein, 244 aa, Artificial Sequence
  Synthetic
MEVKNKNVFVTGSTRGIGLAVAHKFASLGANVVLNGRSEISDDLLAQFADYGVTVIGISGDISNGEDAKRMVAEATEKLGSIDVLVNNAGITNDKLMLKMTEEDFERVLKINLTGAFNMTQAVLKPMSKARQGAIINMSSVVGLMGNVGQANYAASKAGLIGFTKSVAREVAARGVRVNAIAPGFIESDMTDAIPEKMKDAMIAQVPMRRIGQAEEVAEVAAFLASQEYLTGQTIAIDGGMTMQ

SEQ ID NO: 625 - protein, 277 aa, Artificial Sequence; identical to SEQ ID NO: 23
  Synthetic

SEQ ID NO: 626 - protein, 259 aa, Artificial Sequence
  Synthetic
MNSTRNYTLITGASTGIGYELAKLFAKDRHNLILVARDEGKLETAKNELSKYNVEVKILSLDLSKSEDIQGLFNYVEMNKLNVDILVNNAGIGTFGDFSEIEWVKEEALIDINIKVLTKLTKYFLPKIIECKNGGILNVASTAAFCSGPRMAAYYASKAYVLNLTEAIYEECKDSGIRISCLCPGPVKTTFQDKAGIKKSESAKKYLMDAEEVAKVSYKDFKKGKLIIIPGMKNKLLVIGNKLLPRRISRKIILKTNKK

SEQ ID NO: 627 - protein, 249 aa, Artificial Sequence
  Synthetic
MSQTMEGKVAVVTGASRGIGKAIAINLASKGAKVVINYNGSRERAEEVKEIIESAGGKAVIMQCNVADFDACKEFIETVIKEHGRIDILVNNAGITKDGLLMKMSEEDFDKVLDTNLKGAFHTIRFALRQMIRQRSGRIINMASVVGVSGNAGQANYAASKAGVIGLTKTAAREVASREITVNAVAPGFIETDMTDVLPEKVKEASIFQIPLGTFGKAEDVANAVAFLASDEAGYITGQVLHVDGGMVM

SEQ ID NO: 628 - protein, 244 aa, Artificial Sequence
  Synthetic
MAKTVLVTGASRGLGREIAKLFAQNNYNVVINYNNSLKEAECLKEELEHLYHVKTLLVKCNIANEEEVKNMIAKIKSEFSTIDVLVNNAGIALDNSLEEKTSLEFQSVLNTNVIGTFLVTKYSLEILKKGSIINIASTDGIDTGYIEGIDYNASKAGVISLTHDFASVCSPDIRVNCVAPGWINTDMTSNLNPEFRKAETQKILLNRFAEPKEVAEVVLFLASSKASYVNNTVIRVDGGYHEFR

SEQ ID NO: 629 - protein, 277 aa, Artificial Sequence
  Synthetic
MTLPRLLADVSQDAAVNVEDQAVDKVGCLGSEEHSGTAQILGLAPALSGGLGNDELVERMTRAIGLDLAQGRGLRGGDVAGSDAVALNVVLAVLGGNVLGQHLQTALGSSIGGDSLAAQFAHHGADVDDLAAALLDHIGNDSLGNDEGSVQVNVDDLTELGSGHLDHRDALDDAGVVDQHVDVTDLGGDLLDHLIDGVLVGDVADIAVGLDTGLLVGSQTLIDQLLLDVVENDGGAAVRHGGGNGKADAVGCAGDQRDLTGQVKGFGCTDRHKSTSC

SEQ ID NO: 630 - protein, 259 aa, Artificial Sequence
  Synthetic
MALNGKVILVTGAAQGIGRGIALRLAKEGADIALVDLKADKLSDVAKEIKALGRKVTTFAADISNRDEVFAAVEHAEKTLGGFDVMINNAGIAQVKPLADVTPEDMDRIFKINVNGVMWGIQAASEKFKALGHKGKIINASSIAGHDGFAMLGVYSATKFAVRALTQAAAKEYASAGITVNAYCPGIVGTDMWVEIDERFAEITGAPKGETYKKYVDGIALGRAQTPDDVAALVSFLASDDSDYITGQAILTDGGIVYR

SEQ ID NO: 631 - protein, 249 aa, Artificial Sequence
  Synthetic
MINLDGKVCLITGGSRGIGKAIAKKLALHKANIIINYTSNENHALKIKEEIEEYGVKCVLIKCDVSKSSDVENMIETAINEFGKIDILVNNAGVTKDGLLIRMKEEDFDKVIDINLKGVFNCTKSVSKYMMKKRYGKIINISSVVGIIGNIGQVNYCASKAGVIGLTKSSARELASRNINVNAIAPGFIDTDMTSVLNENLKEQMLKNIPQNRFGEPEDVANLVLFLASDMASYITGQVINVDGGMVMQ

SEQ ID NO: 632 - protein, 244 aa, Artificial Sequence
  Synthetic
MELKNKNVFVTGSTRGIGLAVAHKFASLGANVVLNGRSEISEDLLAQFADYGVTVVGISGDISNGEDAKRMVAEAIEKLGSVDVLVNNAGITNDKLMLKMTEEDFERVLKINLTGAFNMTQAVLKPMSKARQGAIINMSSVVGLMGNIGQANYAASKAGLIGFTKSVAREVAARGVRVNAIAPGFIESDMTDAIPEKMKDAMLAQVPMKRIGQAEEVAEVAAFLAGQEYLTGQTIAIDGGMTMQ

SEQ ID NO: 633 - protein, 277 aa, Artificial Sequence
  Synthetic
MQPQIILITGASSGFGKITAQMLSEQGHIVYGTSRKPSENIGKVRMLVVDVTNSISVRQAVEQIISEQGRMDVLINNAGMGIGGALELATEEEVSMQMNTNFFGVVNMCKAVLPYMRKARRGKIINISSIGGVMGIPYQGFYSASKFAVEGYSEALALEVHPFHIKVCLVQPGDFNTGFTDNRNISELTGQNEDYADSFLRSLKIIEKEERNGCHPRKLGAAICKIVARKNPPFRTKVGPLVQVLFAKSKSWLPDNMMQYALCLTLDLVDYYKYQLK

SEQ ID NO: 634 - protein, 259 aa, Artificial Sequence
  Synthetic
MYYNTIKKGDLSMNTQKVVLITGASRGIGASAAKEFARNGYNVVINYFNSKEKALSLKKEIEENYSVKVLTICADVSKEIEVEKMVEEVIEEFHHIDVLVNNAGIAIDTIFEDKTVDNFLKTLEINLIGTFLVSKYVGKYMLENKKGSIINVSSTNGIDTIYPESLDYDASKAGVISLTKNLALEYAPYIRVNSVAPGWVVTDMNQDLSHEFIENEEEHILLKRFADPIEIAKVILFLAGNDASYINGEVIRVDGGFKC

SEQ ID NO: 635 - protein, 249 aa, Artificial Sequence
  Synthetic
MENRILEGKNAIVTGCARGIGHQIVETFAMNGANVWACARKRTEEFDKYASELSLKYGVKITPLYFELTDKDQMKAIVKQIMSEKVAVDILVNNAGITYNALYQMSTIDQIHHTLEVNFIAPYLFTQYIVKLMLKNKSGSIINIASSAGLDGNSGRSIYGASKAAVICATKALAEELGDKGIRANSVAPGITQTDMLSSMTEEVINETVMGTDMKRPGKPEDIANAVLFLASDLSSYITGQVLRVDGCM

SEQ ID NO: 636 - protein, 244 aa, Artificial Sequence
  Synthetic
MNKVAFITGATRGIGSQIAYTLAKQGYNIVVNYRKENEDFENTKKKIQSLNVKFLGVKGDVSNFESCENMIKETIKEFGRIDVLVNNAGITKDMLLLRMKQEDFLSVINTNLVGTFNMTKNVISYMTKQKEGRIINISSVVGISGNAGQTNYAASKAGIIGFTKSLAKEVASRNILVNAVAPGFIETKMTDVLKEEIKEEINKTIPLKRMGTAEDVANVVKFLSSEDSSYITGQVIQVDGGMLM

SEQ ID NO: 637 - protein, 277 aa, Artificial Sequence
  Synthetic
MPKSLQRPVVLLTGASSGIGYDVAPLLVRYGYTVYGAARRVEKIEELASEGVRALSMDVTDEASMEAAVQQIIDAEGRIDVLINNAGYGFYGAIEDVPIDEARRQFEVNLFGLARLTQLVLPHMRARGRGRILNISSMAGRITMPLGAWYHATKYALEAFSDALRMEVEEFGIDVVIIEPGGIKTPWGLIAADHLEESSRNGVYAEQAQRVAANMRKLYSPSSNLSEPKVISRTILRALEARRPKTRYLVGFGAKPSVFLHTVLPDRLFDKVARRIF

SEQ ID NO: 638 - protein, 259 aa, Artificial Sequence
  Synthetic
MALTGKVVLVTGAAQGIGRGIALRLAKEGADIALVDLKEEGLAKVKKEVEALGRKAAVFTADISQRDQVFAVVDKAEQALGGFDVIVNNAGIAQVKAIEDVLPEDMDRIFRINVDGTMWGIQAAAAKFKARGQKGKIINASSIAGHDGFALLGVYSATKFAVRALTQAAAKEFASSGITVNAYCPGIVGTDMWVEIDERFSEITGAPKGETYKKYVDGIALGRAQTPDDVAALVAFLASDDSDYITGQAILTDGGIVYR

SEQ ID NO: 639 - protein, 249 aa, Artificial Sequence
  Synthetic
MLLKGKTAFISGSNGGIGKAILSTFAKEGADIFAHARKPSSAHTDFCKELEQLHSVHIYPVYFDAENYSEIKDCIKQISPISNTIDILVNNLGVVSNPRSFQMTTVEDMKKEFDINFFSQMYLTQYISRFMIRQKSGSIINISSCAGLDGNAGVLQYVSSKSALIGATKRLAIELGSYNIRVNCIAPGLTDTKMSRLMTPDLEEQLLSHQIFKRKAEPAEIADSVLFFASDLSRFVTGQTLRVDGGMLN

SEQ ID NO: 640 - protein, 244 aa, Artificial Sequence
  Synthetic
MNQTVLITGASRGIGAQAARTFAQAGYRVALNYCHSQQEAQALQKELNQQGAQALAVQADVQNRSEVDRMIAQIEAQLGSIDILVNNAGIAQQKLFTDLTEAEWDAMFGVNMKGMFHCTQAVLPSMIRRQCGIVVNVSSMWGVSGASCEVHYSASKAAVIGFTKALAKEVGPSHIRVNCVAPGVISTDMNAALSEETLTQLKDETPLCTLGTPQDIANVILFLASEKSAFITGQTITVDGGMIL

SEQ ID NO: 641 - protein, 277 aa, Artificial Sequence
  Synthetic
MKKRYFDKGVYMNRLKDKVAIVTGSTSGIGKGIAKMFAAEGARVVVCGRREERGAAIVNEIQSAGGEAMYHFLDVTKPETVDALLADTEAAWGKVDVMVNNAAGMALKDGRVDEISLEDWDAVFASDIRSTFYCTKIALPYLKRNDKASIINIGSMAACSGDLGSTAYACAKAGVDMLTKYTALQYGKDGIRCNCVRPGLIITEENADKVPDMLKDIFLDNIEVTRYGSPDDIAAMCVYLASDESEYFTGQVVTVDGGLNAHVPTVAQFRALASRTW

SEQ ID NO: 642 - protein, 259 aa, Artificial Sequence
  Synthetic
MGSTGKKFGGNGMNLEGKTALVTGASRGIGRAIALELAKKGADVLLNYNGSVDRAREVKAEIERLGKSALLYPCDVADYSACETMFRDIFSEHSGLDILVNNAGITRDGLLMRMSEEAFDSVIDTNLKGTFHCMRFATRQMMKQRSGRIINLSSVVGVAGNAGQTNYAASKAGVIGLTKAAAKELASRKITVNAVAPGFIETDMTAKLPEKIREQTFIQIPAGSFGKAEDVAHAVAFLASEEAGYITGQVLHVDGGMVM

SEQ ID NO: 643 - protein, 249 aa, Artificial Sequence
  Synthetic
MIILITGATAGFGESMTRRFIANGHKVIATGRREERLKTLQDELGANLYIAQLDVRNRAAIEEMIAGLPAEWQAIDVLVNNAGLALGLEPAHKASVEDWEDMIDTNNKGLVYMTRAVLPGMVERNRGHIINIGSTAGSWPYSGGNVYGATKAFVRQFSLNLRTDLHGTAIRVTDVEPGLVGGTEFSNVRFKGDDAKASKAYENTQALTAEDVTEAVWWVATLPAHVNINTLEMMPVSQSFAGLSVHRAG

SEQ ID NO: 644 - protein, 244 aa, Artificial Sequence
  Synthetic
MKLEQKNVFITGSSRGIGLAIAHKFASLGANVVLNSRGEISEELLNEFKPYGVKVLAISGDVSDFTDAKRMVDQAIEELGSVDVLVNNAGITQDTLMLKMTEEDFEKVLKVNLTGAFNMTQAVLKQMIKAREGAIINMSSVVGLMGNIGQANYAASKAGLIGFTKSVAREVANRNVRVNAIAPGMIESDMTAVLSDKVKDAMLAQIPMKQFGQAEQVAEVTAFLASQDYLTGQVIAIDGGLTMQ

SEQ ID NO: 645 - protein, 277 aa, Artificial Sequence
  Synthetic
MAKTWMITGVSSGFGREMTEQLLSAGDRVIGTVRSTAKVADLIKKYPDTFDCVILDVTDAAKVTETVNEAAAKHGRIDVYVSNAGYGLFGAAEELSLEEIDRILNTNLRGSIAFIRAAIPHLRKQGGGRIIQISSYGGQVAYPGNSLYHATKFGIEGFCESVGQEVAPFGIDVTIVEPGGARTEFRYGSARVAKLMPEYDGSATHAFLKMLDPKNGLAPGDPAKMAARIIESADTEKPLLHMVLGSQALKATIATLQKRLAEYETETELAASTDIVE

SEQ ID NO: 646 - protein, 259 aa, Artificial Sequence
  Synthetic
MVAVITGASGGIGKETAKILVSKGWEVICLQRRDCEVEGTQSIKCDITNQQDIDRAFSMIDKIDLLINNAGFGVSGCVEFTDMSEIRSQFELNFFAHIAVTKAALAKLRESKGRVIFISSAASVFSIPFQSFYSATKSAAESVSLALSNELKQFGVSVCSVRLGDVKTGFTAARKKDFAGDDVYGGAIARSVAVMENDEINGMKPEYVAQKIVEISQKKHLPVLATVGGTYKLFCLLQKLLPASLVNKIVGKMYMPPEK

SEQ ID NO: 647 - protein, 249 aa, Artificial Sequence
  Synthetic
MDIKITGKRAIVTGAGTGIGRAIAQDLAEAGAKVLIVGRTESTLKETASLHQDIDYLVADLNKDEDIEKIVQAAQEKLDGLDILVNNAGWAPVTPLGSVKSQEFNAAFGTNTRAVFLLTQALLPLLKESKGNIVNVSSAAAARPVPTMSVYSGSKAAVNAFANAWAKELAPLGIRVNTINPGPIETPIYDKTELSEEEMKAHRKKVTDMTPLARFGKPEEVSGAVLFLASDKASFITGSELAVDGGQAL

SEQ ID NO: 648 - protein, 244 aa, Artificial Sequence
  Synthetic
MSKVALITGATRGIGKEIALTLAKEGYDISLNYRKENEDLDSTKKQIEELGRKCLAVKADVSSFDECENLVKQTIENFGQIDVLVNNAGITKDNLLMRMKEEDFKDVINVNLVGTFNMTKNTISYMMKARQGRIINISSVVGIAGNAGQTNYSASKAGIIGFTKSLAKEVASRNILVNAVAPGFIQTSMTDVLKEDIKENIAKSIPLKRMGTAKDVANVVKFLASDDSSYITGQVINVDGGMLM

SEQ ID NO: 649 - protein, 277 aa, Artificial Sequence; identical to SEQ ID NO: 22
  Synthetic

SEQ ID NO: 650 - protein, 259 aa, Artificial Sequence
  Synthetic
MKKQCCADKKIVLVTGATSGIGEGCAKRFAEGGYDVIITGRNTAKLEAVKNELQQRGADVLALAFDVRDREAARKAVEGIPETWKDIDVLINNAGLARGLEPEYQGNFDDWDQMIDTNIKGLLTMTRLIVPGMVSRNHGHIINIGSVAGDAAYAGGNVYCATKAAVKAITDGLRIDVADTKLRVTNIKPGLVETNFSNVRFHGDTQRADNVYRGIQPLTGDDIADVAFYAASAPEHVQIAEVLVLATHQANGTVIHRDE

SEQ ID NO: 651 - protein, 249 aa, Artificial Sequence
  Synthetic
MDQTMEGKVAVVTGASRGIGKAIAIALAKEGASVAVHFHGNEEKALLVKKEIEEAGGKAEVFRANVADFEECNALVKAAAKTFGSIDILVNNAGITKDGLLMAMSEADFDDVIDTNLKGCFQMIRFASRRMMKQRYGRIINVSSVSGVAGNAGQANYCASKAGMIGLTKSAAKELASRGITCNAIAPGFVKTEMTDVLSDEVKENAKKQIPLGRFAEPEDIANAAVFLASDKAAYITGQVLLVDGGMVM

SEQ ID NO: 652 - protein, 244 aa, Artificial Sequence
  Synthetic
MKLEQKNVFITGSSRGIGLAIAHKFASLGANVVLNSRGEISEELLDEFKPYGVKVLTISGDVSDFADAKRMVEQAIEELGSVDVLVNNAGITQDTLMLKMTEEDFEKVLKINLTGAFNMTQAVLKQMIKAREGAIINMSSVVGLMGNIGQANYAASKAGLIGFTKSVAREVANRNVRVNAIAPGMIESDMTAVLSDKVKDAMLAQIPMKQFGQAEQVAEVTAFLASQDYLTGQVIAIDGGLTMQ

SEQ ID NO: 653 - protein, 277 aa, Artificial Sequence
  Synthetic
MSKTWLITGVSSGFGYEMTKQLLAKGDVVIGTVRNKEKVQKLIDEYPLGFDCQILDVTDVPAVQKTVHTAFEKHEKIDVVVSNAGYGLFGCAEELSDTEIEQIIATNLTGSIQLIKTALPYMRKQGGGRIIQISSYGGQVAYPANSMYHATKFGIEGFCEAVAQEVAQFNIGVTIVEPGGARTEFRYGSAKVANLMPEYDSCHGFLNMLDASKGLAPGDPARMAERIIESVDKEPAPLRMVLGSQALSATISRLKERIADYETQTELAASTDYPAGE

SEQ ID NO: 654 - protein, 259 aa, Artificial Sequence
  Synthetic
MGKLTGKTALITGASKGIGEGIARTFLKHGAKVILAARGAAVEELAAQLGENAMAVRMDVSDPASVKAGVEAAQATFGPIDILVSNAGICKLGDFLTQSDEDRDAHLDINVKGAWNTCKAVIPGMLERKWGKIVIMSSVTGDIVADPGEAAYAMSKAALVGLTKALAREFAPTINVNAICPGYVLTPMVKGMAQQSCPDNPQSVIDGIASAIPLGRLADPTEVGELAAFLASDEASYLTGAQFVIDGGSTLPETSTMGV

SEQ ID NO: 655 - protein, 249 aa, Artificial Sequence
  Synthetic
MVNFSLEGKVALVTGASYGIGFALATAYAQAGAKIVFNDIKQELVDKGLAAYKAEGIDAKGYVCDVTNEEQVNAMVAQIEKEVGVIDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITDMTAKLSDEVKAEWAKKIPLRRGGTPEDVADVATFLASDMSSYVSGQVIQVDGGMNM

SEQ ID NO: 656 - protein, 244 aa, Artificial Sequence
  Synthetic
MKHALITGGSNGIGKELVYRFANSGAKVSFIYNKSIEKAEAIVKDLKDFYGINVNAFQCNISDEDAITDLFRNNKTIFSDVDVLINNAGITGTAKPFLMTSSSDWWKVMVNNVGGVINCTRKVLPTMIRNKTGRIVNITSLSGLKGNPGMSAYSASKAAIVAFSKSLSKELKGTGIIINCLAPGFIQTDMTQDLSEEYYTQRMLNSISGRMGTVKEAAEMVLFLAKDAPDYFINQEVILDGGIS

SEQ ID NO: 657 - protein, 277 aa, Artificial Sequence; identical to SEQ ID NO: 2
  Synthetic

SEQ ID NO: 658 - protein, 258 aa, Artificial Sequence
  Synthetic
MALYKTVLVTGASAGFGFAICEKLASQGYKVIATARRQDKLDALANKYEGQIFPLKLDVTDTEAVDSILDKLPDEFKNIDVLVNNAGLALGQDKAFTCSLKDWHTMVNTNIKGLLNITHKLLPLMVKKNKGYIINLGSTAGAWPYTGGNVYGGTKAFVEQFSRNLRCDLAGTALKVTVIKPGLCSNTEFSNVRFKGDNEKAAAVYKDVEAILPEDIANTVDYLLSTPAHMNINELEIMPVCQTFGGLLVTRNLDLDEK

SEQ ID NO: 659 - protein, 249 aa, Artificial Sequence
  Synthetic
MYNPYSLAGKTILVTGASSGIGKVVAQECAKMGASLVISGRNPERLHETFVSLEGGGHIEIVADLLQYEDIESLTGQCPLLDGFSNNAGITKILLLKNLQRKYLEEIMNTNAIAPILLTQLLTKKKKWKKPSSIVFTSAISGNYCVHYGESMFAASKGAVCGFAKGAALDLAAQNIRVNCVTPGVIKTDSLMNSGVLTQEELKEKENYFPLKRFGDPKDVALAVIYLLSDASSWVTGDNLILDGGYTLL

SEQ ID NO: 660 - protein, 244 aa, Artificial Sequence
  Synthetic
MELKDKNVLITGSTRGIGLAIAHKFASLGANIILNGRGEVSEDVLAEFKGYPVKVFAVTGDVSDSADAKRMVEEATLAMGSVDVLVNNAGITKDKLMLKLTEEDFEQVLKVNLTGAFNMTQAVLKPMTKARQGAIINMSSVVGLTGNIGQANYAASKAGLIGFSKSVAREVAARNIRVNVIAPGFIESDMTDGLPEKIKEASLAQIPMKRFGNTEEVADVAVFLATQEYLTGQVIAIDGGLTMQ

SEQ ID NO: 661 - protein, 277 aa, Artificial Sequence
  Synthetic
MEKRYFDKGVYMDRLKDKVAIVTGSTSGIGKGIAKMFATEGARVVVCGRREERGAAIVDEIKAAGGEAMYHFLDVTKPETVDALLADTEATWGKIDVMVNNAAGMALKDGRVDEISLEDWDAVFASDIRSTFYCTKIALPYLKRNDKASIINIGSMAACSGDLGSTAYACAKAGVDMLTKYTALQYGKDGVRCNCVRPGLIITEENADNVPDTLKDIFLDNIEVTRYGSPDDIAAMCVYLASDESEYFTGQVVTVDGGLNAHVPTVAQFRALASRTW

SEQ ID NO: 662 - protein, 258 aa, Artificial Sequence
  Synthetic
MNRIIVVTGGAGGIGRCIVAHFASQGDSVYFIDQNQQATLAQMEKMRKKGWQVTGFVGDVAEKQILEEFAALVLCEHPEGIHCLINNACLMRGGILSDCEYEDFLYVQRVGVVAPYMLSRLFKDHFQGMGAIVNISSTRAFQSQSDTESYTAAKGGITALTHALAVSLSGVARVNSVAPGWIDTGAYHDDTNYEAVYSTGDTAQHPSGRVGEPADIARVVDFLCDERNSFINGENITVDGGMSRLMVYHNDCGWTYEP

SEQ ID NO: 663 - protein, 249 aa, Artificial Sequence
  Synthetic
MNILITGATKGIGYEIALQFIKRNHKVFGVGRNWENVSNNEIIPIKCDISRKEEREKLFSYFAEKNIEIDILVNNAGVGSIGVFENISWEESAGLIDLNVTALTHMCSLFLNSMKDRKNIPEDAGIINVSSTGAYEEGGPYTAVYYAGKSFVKSFTNALCEELRDKKIKVMCLCPGPVKTDFKGMKNSRKSFYIMTPEKTAEIAVCDYFKGREICITGVINKIFVFISKFIPRKTGLKIIKNIQKKKIK

SEQ ID NO: 664 - protein, 244 aa, Artificial Sequence
  Synthetic
MSFEGKIALVTGASRGIGRAIAETLVARGATVIGTATSESGAQAISDYLGAKGKGLMLNVTDPASIESVLEKIRAEFGEVDILVNNAGITRDNLLMRMKDDEWNDILETNLSSVFRLSKAVMRAMMKKRHGRIITVGSVVGTMGNAGQTNYAAAKAGLIGFSKSLAREVASRGITVNVVAPGFIETDMTRALTDEQRAGTLAAVPAGRLGDPKEIASAVAFLASDEAGYITGETLHVNGGMYMV

SEQ ID NO: 665 - protein, 269 aa, Artificial Sequence
  Synthetic
MKNYKSLKDLTNKVVLITGASGGLGEQIAYQVAKKGAIVVACARRKEKLDVVVENCQNLSKRLAYAYQLDISKPEEVEKVVNEVEEEVGPVSVLINNAGFGLMEDFLDFDMDRAEAMFRVNVLGLMYATKYVATKMAERQVGAIINIASMAGKMATPKSTVYSATKFAVLGFSNALRLELKPLGISVMTVNPGPIRTEFFDKADKTHNYLNSLGNIVLDPEEVAYKIVSKIGTSRREVNLPYYMEVAHHLYEVFPHMADYLTGGIFNKK

SEQ ID NO: 666 - protein, 258 aa, Artificial Sequence
  Synthetic
MNRLENKVAIITGAAMGQGAAEAYLFAKEGAKVVATDMCEDILRETVQKINEDFPHSTIALKLNVTDEEEWKKVVEECINQFGTVDILLNNAGIGSKGINYDKTDYQAFENVMKINAWGPFVGMKTVAPIMIKNKKGSIINVSSLAAVKSIEFNAYSLSKGAVISLTKAASADLGKNGIRVNTIIPGTIETPMTKIICDYPNVLNSCIEKTALGHIGEADDIAYCALYLASDESKYTTGTDITIDGGQRYKDTLELEM

SEQ ID NO: 667 - protein, 249 aa, Artificial Sequence
  Synthetic
MNEETIIRTAVVTGGSRGIGRAVCVQLARQGCHVVVNYCHGEAAAAETVSLCRAEGAQAVAVQADVSTAEGCKKLFEEAVNAFGRVDILVNNAGITRDNLILRMSEEDFDAVLNANLKGAFLCCKEAARRMVRQRWGRIVNLSSVVALRGNAGQTNYAASKAGLIGLTKSLARELASRNVTVNAVAPGFIETDMTAALPEAVRAEMAKGIPAGRAGRPEDVANAVAFFAAEQSSYLTGQVLCADGGMAM

SEQ ID NO: 668 - protein, 244 aa, Artificial Sequence
  Synthetic
MKTVLITGAAKGIGKAIATKFANLGYKVVINYNRSEELAKKLQEELLKINKEIYICQADITKIDDVNRLVNFTLENCGSIDVLVNNAGISKANLFIEDSIEDMNSIIAVNLMGTLNVTQTVLKKYMVSKKDGTIINLSSIWGITGASCEVMYSTTKSAIIGFTKALAKEMGPSNIRVNTVAPGFILTDMTSNLTEEEINDFREKIPLERVGNVEDIAGVVTFLASDDASYITGQVISPNGGVVI

SEQ ID NO: 669 - protein, 277 aa, Artificial Sequence
  Synthetic
MSEHRIDETCRYEEDFTIRNFNKMMDGKVVIVTGASYGMGKKMAQLMVEQGAKVFVTARGKEKLDAAIADIKEKTGGDITGITADSSRPEECKKVFEKALEAYGDIDVLINNAGKGELITIDAVSDEVIDQVVDTNMKGPLYLCREAVRYFLKKDSGNIINISSVNGIRPMCGAAYCATKGGLNTLTKNVAIRCTGTGVRCNAVAPGHTPSPTAYAHDDGGPQTLAEGVMNEVRNTRTVRSVHPWEIDQAYAVLFLASDMSRCINGEVLSVDCGCYL

SEQ ID NO: 670 - protein, 258 aa, Artificial Sequence
  Synthetic
MTEKVERAMFDYFGLEGQTAIVTGSGNGIGRATAIMLADLGANVMVCDIETDSAKKVEEEILGRGGKAVSNRCDVTKLEEIKETIRKTVEAFGTVDILVNNAAGFGGGKTFDKMTYEEWDRLIRINLTGAYMFTNEVLPYMVEKQHGKICMVSSGAALGYDFSDPHYAASKAGMIGLAKELSQELAKHRINVNVLGTGLTDTRMAHLPGRSWEDETKGLPWYRVGTPKDQASAIVFLVSEAAEYITGQVLCPNGGAWM

SEQ ID NO: 671 - protein, 249 aa, Artificial Sequence
  Synthetic
MKRLEGRTALITGCNRGIGRAIMQELVTEGADIVACTRKQTDEQDAFYMQCKSKYGIQIYPIYFDLNDENAIQVALKEIYSLKIVIDVLVNNAGILNTDGLLRLKMEDAHRVMQVNYFAPLQITQGIVKLMLRSKSASIINVASIAALKPTVGNTVYGASKAALISMTTCWAKELASAKIRVNAVAPGYLDTDMSTSVDRKMMAQLVDDTSLKRLGTTEEVAKVVSFLASDDSSYIDGEIVKITGGYRI

SEQ ID NO: 672 - protein, 244 aa, Artificial Sequence
  Synthetic
MKKTAWITGASGGIGSAIAVLFAQNGYRVALGYQRGKQKAEALAQELCASGVEALAVGGDLANRQTAFAAAQMIQENFGSLDVLVNNAGISQVGLFDCMTEEEWRRICGANLDSAIYCSQAASKYMISRKSGSIINIASMWGEVGASCEVAYSVTKAGLIGLTKALAKELGPSGVRVNCVSPGMINTEMNAHLAAAEVAEIADETPLGRIGTPAEVARAVLFMAGEEASFITGQVLGCSGGLVV

SEQ ID NO: 673 - protein, 277 aa, Artificial Sequence; identical to SEQ ID NO: 20
  Synthetic

SEQ ID NO: 674 - protein, 258 aa, Artificial Sequence
  Synthetic
MTEKTWKATLDYFGLEGQVAIVTGAGNGIGEATATMLANLGAKVAVCDIEIARAERVAQNITNCGGTAIAVACDVGSQEQIERAVEEVAAQLGSIDILVNNAAGFGGGKTLDQVDLKEWDRLIHLNLTSAYMFSMAVLPYMKEKKHGKICNVSSGSGIIGDNTDVHYASAKAGLIGMTKEMATELMPFQINVNALGTGLTDTRMSRRSYWEQKKNSISWHRVGEPKDQAAAITYLVSEAAEYLTGQVICPNGGAWMHG

SEQ ID NO: 675 - protein, 249 aa, Artificial Sequence
  Synthetic
MIVLVTGATAGFGESITRRFIANGHKVIATGRRNERLKALKEELGDSVLTVQLDVRNRAAIEETIANLPAEWRDIDILVNNAGLALGLEPAHRASVEDWEDMIDTNNKGLVYMTRAVLPGMVERNRGHVINIGSTAGSWPYAGGNVYGATKAFVRQFSLNLRTDLHGTAVRVTDIEPGLVGGTEFSNVRFKGDDAKAGKTYENANALTPEDVTEAVWWVATLPKHVNINTVEMMPVSQTYAGLSVHRES

SEQ ID NO: 676 - protein, 244 aa, Artificial Sequence
  Synthetic
MSFEGKIVLVTGASRGIGRAIAETFVARGAKVIGTATSESGAEAISSYLGANGKGFMLNVVDAQSIDSVLASIRAEFGEIDILVNNAGITRDNLLMRMKDDEWEDILDTNLTSVFRLSKAVMRAMMKKRFGRIITIGSVVGTMGNAGQANYAAAKAGLIGFSKSLAREVASRGITVNVVAPGFIETDMTRALTDDQRAGILSSVPANRLGDAKEIASAVAFLASDEAGYITGETLHVNGGMYMI

SEQ ID NO: 677 - protein, 277 aa, Artificial Sequence; identical to SEQ ID NO: 21
  Synthetic

SEQ ID NO: 678 - protein, 258 aa, Artificial Sequence
  Synthetic
MNRIIVVTGGAGGIGRCIVAHFASQGDSVYFIDQNQQATLTQVEKMRERGWRVTGFVGDVVEKQALEEFAALVLREHPEGIHCLINNACLMRGGILSDCDYESFLYVQRVGVVAPYMLARLFKDHFQGLGAIVNISSTRAFQSQPDTESYTAAKGGVTALTHALAVSLSGVARVNSVAPGWIDTGAYHEEAHYEAVYSTGDTAQHPSGRVGEPADIARVVDFLCDERNSFINGENITVDGGMSRLMVYHNDCGWTYEP

SEQ ID NO: 679 - protein, 249 aa, Artificial Sequence
  Synthetic
MKKNDFENKVVLVTGGTGGIGLATVKEFMKENAFVYFTDINAEKGQQTEKHLGNNVTFIKHDVASEEDWKNVIGRIEKEHGKLDVLVNVAGISLYKPFGKMSLEEYMRVVNINQVSVFLGQKYTLELLKKGDNPAIINIASIAGLEGSRDGAAYHSSKAAVISLTECAALEFADFGIRVNSISPGAVLTDMVLNNEEYRDAINKMIEAVPLKKIANSEDIAKAISFLASSYAPVITGTNLIIDGGSTKV

SEQ ID NO: 680 - protein, 243 aa, Artificial Sequence
  Synthetic
MKTVLITGASKGIGAEIARTLAKEGYNVAINFNKSERAAVALKNELEKYTSVMLVKADVSKYDEVASMVSAVRNKFGSITHLVCNAGISVTGLLEDMDLCQCDSVIDTNLKGVIYTVKEVIPDMVKRKSGVIVNVSSIWGKTGASCEAVYSASKAGVIAFSEAMAKELGLSGIRVNAVCPGCIDTDMMRKENFTACEMQTLIDETAIGRIGTPKDVADVVSFLLSDKSSFITGQAITVDGGFI

SEQ ID NO: 681 - protein, 277 aa, Artificial Sequence
  Synthetic
MKNVLVTGASSGLGKEIALTLAQNGFKVFAGVRKQEDKAALEALNPSIQTVFIDVTSDESVNEAFEVIKSQTDSLYALVNNAGIALAGPVECLPVEVIKKQFEVNVYGAIRTAQKFLPLMDNSRIVNISSMASFGLFPFVSPYCASKRALDIFFNALLLECKKPDLKVISIKPGVVKTAIWDKSINECTKILDNIPEEFHKKYEKEYEFLVKNARKNNDKGLEPAQIGKLVLKVLTIKNPKLSYCAGFDAKMTALFSKLPLSVINFLTKASMKNRLS

SEQ ID NO: 682 - protein, 258 aa, Artificial Sequence
  Synthetic
MKGENRMKKLENRVAVITGGSRGIGKGIALTFAKEGADIVFSYHSNAKAADETVREIEALGVKAVAVKANAGDERDVKNMVEITAKEFGKINILVNNAGTIGKEVPVADMDTEEWDRVINTDLRGVFLSCKYFIPLIEKGKDAPVGKIINISSELSKKGRACYGHYAAAKGAINSFTMCLALEMAPDILVNIVAPGPVETDMILADMEPEWVEKEKDIPLKRLGTVEEIGAAALLLASDEGNFFCGQFVSPNGGAVFF

SEQ ID NO: 683 - protein, 248 aa, Artificial Sequence
  Synthetic
MFILDFKGKVVFVTGASRGIGKAIAQNFEQLGATVYGTATSENGAQGITEYLNGHGKGFVMNSLDKQSVEDCFNAVVAEAGTCPDVLINNAGITRDGLFMRMKDNDWNDVLQCNLFACVQLSKLCVTPMMKKRAGRIINIASIVGQDGNAGQCNYSAAKAGLIGFSKSLAKEVGSRGITVNCIAPGFVATDMTAALNEEQLKAWTNTIPLKRAATADDIAASAVFLASDMASYITGSTIDVNGGLHCN

SEQ ID NO: 684 - protein, 243 aa, Artificial Sequence
  Synthetic
MSIAVVTGASGGIGAEIAKRLAQDGFSVALIYNRNAEKAQKTADEITLSGGSAKTYKCDVRDSSEITSAIEAIERDFGEISVLVNNAGISEQKLLTDITDSDWENMISTNLSGAFYFCRAVLPYYVHRKSGRIINISSMWGETGGSCEVHYSAAKAGLIGLTKALAKEVAPSGITVNAVSPGVINTEMVTKLGKDTVDMLREEIPVMRLGTPEDVANAVSFLADDKSSYITGQIISVNGGIVI

SEQ ID NO: 685 - protein, 277 aa, Artificial Sequence
  Synthetic
MTKTWLITGCSEGGIGAAIARAALRAGYNVAVTARNLEKITSIVSEYPKQAFPVQLDLTDTASIRNAVRKTMEYFGGIDVLVNNAGYCYRSSVEESVESEVMRMFQTNLFGLIELTKEVLPFMRGQYSGTIVNFSSVAALSANPASAFYASSKAAVELLSDGLRKEVSPLGIRVIVVEPGAFRTNFFSTSLRGTQMKIADYQDTAWKRYPENAIDTGDQPGNPDKAASVLLKAIQSDNPPFRLLLSKQAVDFARQEYKNRLIEIDKWQSLSETTDFD

SEQ ID NO: 686 - protein, 258 aa, Artificial Sequence
  Synthetic
MNQNWIHANMEHYFQLAGKTAIVTGAGNGIGRGIAQKLAGLGANVVACDIEAESVRNTADEITLAGGVCLGLYCDVRKYEDIQKVVDTAVQKFGTVDILVNDAAGCGGGVTVDTINEQEWMRLIELNLNSVFRFTMTVLPIMRAKKQGKIVNISSGAGITGDFSDPHYAAAKGGVIAFTKELAHELAKESINVNSVAPGLVDTRMARIRDWEDEIADTLWPRAGQPEDIANAVAFLASSASDYFTGQVISPNGGAWMQ

SEQ ID NO: 687 - protein, 248 aa, Artificial Sequence
  Synthetic
MMDLTGKTALITGASRGIGKAIALKLAGQGANIAIPYLGDPAEAEQAQKEIEALGVKCVMYVCDVSSFEASKEVVEKVIEEFGGVDILVNNAGIVRDKLILSMKEEDFDMVINVNLKGAFNMIKHTYSHFMKKRRGRIISISSIVGLNGNAGQANYSSSKAGLIGLTKSTAKELGGRNITVNAIAPGFIDTDMTQQLSDKVKDAMKAQIPMKRPGTPEDIANLALFLASDEASYITGEVIRVDGGYAM

SEQ ID NO: 688 - protein, 243 aa, Artificial Sequence
  Synthetic
MKKTVLITGASRGIGRAIAVAFAKAGYNLVITCSKSETELLHLKNDLERDYSVDVLASIGDISDFEYVTQLFSHIEQRFHGVDVLVNNAGISYVGLLTDMTIDEWNHILGVNLTSVFSTCKLAIPHMLSRKSGKIINISSVWGNVGASCEVAYSACKGGMNSFTRGLAKELAPSNIQVNAIACGCIDTQMNACFSEEERAALTDEIPAGRFGMPEEVASLVLTLAEGNEYLTGQIITLDGGWI

SEQ ID NO: 689 - protein, 277 aa, Artificial Sequence; identical to SEQ ID NO: 25
  Synthetic

SEQ ID NO: 690 - protein, 258 aa, Artificial Sequence
  Synthetic
MSEFTNFSLEGKVALVTGASYGIGFAIASAYAECGATICFNDIKQELVDKGMAAYAEKGIKAHGYVCDVTNEEAVNAMVAQIEKEVGTIDILVNNAGIIKRIPMTEMTADQFRQVIDVDLNAPFIVSKAVIPGMIKKNHGKIINICSMMSELGRETVSAYAAAKGGLKMLTKNICSEYGQYNIQCNGLGPGYIETPQTAPLREIQPDGSRHPFDQFICAKTPANRWLKPEELTGLQIPTAARASFPTKCPTMMLSTAL

SEQ ID NO: 691 - protein, 248 aa, Artificial Sequence
  Synthetic
MKLLDGKVAVVTGAARGIGKAIALEFAKEGANVAFTDLAIDENGKATEAEIAALGVKAKGYASNAANFEETHAVIDQIIKDFGRIDILVNNAGITKDGLMMRMSEAQWDAVLTVNLKSAFNFIHAVVPVMARQKGGSIINMSSVVGVSGNAGQCNYSASKAGMIGLAKSIAKEMGPRGIRANAIAPGFIMTEMTDKLPDEVKEGWYKQIPLRRGGTPEDVAKVALFLASDLSSYVSGQVIHCCGAMNC

SEQ ID NO: 692 - protein, 243 aa, Artificial Sequence
  Synthetic
MKKTALVTGGSGGIGSEICRALAEDGWQVAVCYKNGRATAEALVSELKERGLCAEVFYCDIGDKDSIDKCVAEVRDSLGFVTLLVNNAGTADIELFTDMTDEKLCEMMNVNLLGAMRMSRTVLPEMIREHSGNMINITSVWGEKGASCEVAYSAAKAGLIGFTKALAREVAISGIRVNCVSCGMIDTKMNGELTEEDVRVIVDDIPAGRIGKPRDVANVVRFLSGEGADYIHGQVVRVDGCWI

SEQ ID NO: 693 - protein, 276 aa, Artificial Sequence
  Synthetic
MERVWFITGASRGFGRAFTEEAVKRGDKVIATVRRVPHDDIFKHPSVLTVVMDVTKTDEVEKAIKDGMDRFGRIDVLINNAGFGFSGAFEETTDEDLRNLFETDYFGVVNVTRRVIPLMRKAGKGVILNVSSQGGLMGFSGSSAYCAAKFAVVGLSDVLRAELGEFGIAVSAVCPGSFRTDFRSKHSFRNPSARLDAYKDSSAHKAAKFLAENTYTQTGNPQKAAQFLLDMVEKGNLPPRILIGAACCRAMKARYEAELKDIASYEAAASKTDFEE

SEQ ID NO: 694 - protein, 258 aa, Artificial Sequence
  Synthetic
MGKHKYTLITGASSGIGYELARLFAKDKHNLILIARNIDKLQEVKVELMSNNIDVKILSLDLSKNEDIENLFNYIKINKIEINTLINNAGVGTFGDFKDILWEKEEELIDINIKSLTKLTKYFLQQIIKEKNGGILNVASTAAFCSGPRMASYYASKAYVLNLTEAIYEECKNTGVKISCLCPGPVKTGFQGKAGIKKSEAAKKYLMDAKDVANIAYKEFNKGKLIIIPGIKNKLLVLGNKFLPRCISRKIILLTNKK

SEQ ID NO: 695 - protein, 248 aa, Artificial Sequence
  Synthetic
MGLLTGKTAIVTGAARGIGKAIALKFAAEGANIAFTDLVIDENGQNTEKEIAALGVKVKGYASNAANFEDTEKVVNQIKDDFGSVDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITDMTAKLSDEVKAEWAKKIPLRRGGTPEDVADVATFLASDMSSYVSGQVIQVDGGMNM

SEQ ID NO: 696 - protein, 243 aa, Artificial Sequence
  Synthetic
MARKTVLVTGASRGIGKAIAVKFAKKGYNVVISCVRREEQLLQTKKEIESFQVSCLSYLGDMGVAENCAELFKKIRKQFGGLDVLVNNAGISYIGLLQDMKPEDWELILRTNLTSVFNCCKLAIPMMLEKKQGKIINISSVWGVCGASCEAAYSATKGGVNALTKALAKELAPSNIQVNAIACGAIDTEMNHFLDDEELIGLIEEIPAGRLGRAEEVADLAYHLGYKENYLTGQIIGLDGGWV

SEQ ID NO: 697 - protein, 276 aa, Artificial Sequence
  Synthetic
LIYIKRKGDFKMSVNFSLEGKVALVTGASYGIGFAIASGMAKAGATIVFNDIKQELVDKGLAAYKEAGIDAHGYVCDVTNEEQVNAMVAQIAKDVAPIDILVNNAGIIKRIPMCDMTAAEFRQVIDVDLNAPFIVSKAVIPSMIERGHGKIINICSMMSELGRETVSAYAAAKGGLKMLTRNICSEYGQYNIQCNGIGPGYIETPQTAPLRERQADGSRHPFDQFICAKTPANRWLKPEELAGPAVFLASEASDAVNGHILYVDGGILAYIGKQPQ

SEQ ID NO: 698 - protein, 258 aa, Artificial Sequence
  Synthetic
MESRLNGKVVLITGATAGIGRSTAFGFAKMGCKLILMIRNAEKGEHLKKEIQEKYNVEIKLLVVDVRDAKGIEKAIHDLPEDWQKISILVNNAGLAYGLDKVYLAEIDDIDTVIDTNIKGMLYVTRVVVPLMLKYNIEGHVINIGSIAGTAAYAGGAIYCATKAAIKLLSDGLRIDLVDTPVKVTNIQPGVVETGFSMVRFKGDKERADAVYRGIEALTPDDIADTIVYAANIPHNVQLTEITMTPQHQADGRCIYKK

SEQ ID NO: 699 - protein, 248 aa, Artificial Sequence
  Synthetic
MSGRVVLISGGTSGIGLAAASLFLQAGDRVILMGRSAARGQSAVDELSAAGQVSFIAGDVSSRQDCARVVEQVLNENGQLDVLVSSAGVYLEGAIEDMTEDQLDEILAVNVKGTYYLCQAAVPALKQSKGNIVNVASDAGIHGNYYCTAYCASKGAVVLFTRALALELAGFGVRVNAIAPGDILTPLTEAQLAQQPDREAGLREMASVYPVGRIGTPSEAAAVIAFLASPAAAFVTGAVWSVDGGLTA

SEQ ID NO: 700 - protein, 243 aa, Artificial Sequence
  Synthetic
MQLTNKNVFVTGSSRGIGLAIAHKFAKLGANVVLNSRGTISEDLLAEFSNYGVKVVPISGDVSDFADAKRMIDQAIAELGSVDVLVNNAGITQDTLMLKMTEEDFEKVIKINLTGAFNMTQAVLKQMIKAREGAIINMSSVVGLMGNIGQANYAASKAGLIGFTKSVAREVANRNVRVNALAPGMIESDMTAVLSDKVKEATLAQIPMKHFGQAEHIADATVFLAGQDYLTGQVLAVDGGLSM

SEQ ID NO: 701 - protein, 276 aa, Artificial Sequence
  Synthetic
MDKRTWLITGVSSGFGYEMTRLLLENGETVVGTVRNREKVKELTEKYPVTFDCRLLDVTDVDGIYEIVDAAFTEHGKIDVVVSNAGYGLFGAAEELTDEQVNQIIATNLTGSIMVIRSALPYLRKQQGGRIIQISSYGGQVAYASNSMYHATKFGIEGFCESVAQEVAKLGVGVTIVEPGGARTEFRYGSARVANLMPEYEHCHGFLNMLNPENGLAPGDPMEMSRRIIESADLAPAPMRMVFGSQALKATIERLEERVADYKTQTELAASTNIQE

SEQ ID NO: 702 - protein, 258 aa, Artificial Sequence
  Synthetic
MKNLFDLTGKVALVNGASSGLGASAAVAYAEYGADVIICARRIEKLEEVKKQIEALGRKCLAVKCDATVEDEIKNAVQKGIEAFGHIDILLNNAGIAVRGGVDSLNVEDWDKSFNTNVRSDFLFSKYVIPHMIEQKYGKVVNVASVNAVVGDKDDRFIRHAYNASKSAVLGLTIGMADSYGKYGITVNAIGPGLFETEMTQNTLFKSPQFLGYYGQINPMGRPGAKGELNGTVIYLSSDASSYVTGEFILVDGGATLV

SEQ ID NO: 703 - protein, 248 aa, Artificial Sequence
  Synthetic
MGLLTGKTAIVTGAARGIGKAIALKFAAEGANIAFTDLVIDENGKNTEAEIAAFGVKAKAYASNAANFEETAKVVEQIKEDFGSIDILVNNAGITKDGLMMRMSEAQWDAVIGVNLKSAFNFIHACTPIMMRQKSGNIINMASVVGVHGNAGQCNYSASKAGMIGLAKSIAQELGSRGIRANAIAPGFIITDMTAKLSDEVKAEWAKKIPLRRGGTPEDVANIALFLASDLSSYVSGQVIQVDGGMNM

SEQ ID NO: 704 - protein, 243 aa, Artificial Sequence
  Synthetic
MELTNKTVLITGSSRGIGAATALAFAKAGSRVILNARHELPASLKQQLDELGTEYCFLPGDVSDEHVVKELTKTAWEKFGGIDVLINNAGITRDRLLIGMKTADFDEVLQVNLKGPFLMIQALLKKMYKQRAGVIINLASVVGLHGNAGQANYAASKAGIIGLTKTVAREGALRGIRCNAIAPGMIASDMTAAMPQKAQDQILASLPLKRFGEPAEIAQTALFLAQNDYVTGQTIVVDGGMTI

SEQ ID NO: 705 - protein, 276 aa, Artificial Sequence
  Synthetic
MQTWLITGCSSGLGWGFAKAVLKSGDQVIVTARRVETLKDLVDAYPEQALALSLDVTKEEDIKNAVEKGLERFGTIDVLINNAGYGYRAAVEEGVPKEVDQLFQTNLFGPIALIKAVLPIMRKNHRGTIANVSSIAALGAALGSGYYAATKSALESISEALYGETKDLGIHVMIIEPGAFRTNFAGTSLKESSVELGDYEKTAGTRRIRNDHTDGTQQGDPDEAGRVLVDLVHSGKMPLRLLLGSDAQAYGKSRLTARLDEYKAWEVTSNRTDFKE

SEQ ID NO: 706 - protein, 258 aa, Artificial Sequence
  Synthetic
MTVVITGASSGIGKETAMAFLKNGDKVYCLSRRPCDLNGIINIKCDITDENQVESAFEEIETIDLLINNAGFGISGAVEYTELSEMKSQFELNFFAQICVTQCALQKLKQSKGKIIFVSSAASVFSIPFQSFYSATKASIESLTAALRNELKMFGVQVGCVRLGDIKTGFTAAREKSFKGDEAYNGMISRSVSVMEKDETNGMPPSAVAKTILKISSKKNLPLVTTVGAQYKFLCFLSKILPGGIVNKLVGSIYMPKK

SEQ ID NO: 707 - protein, 248 aa, Artificial Sequence
  Synthetic
MKLLEGKVALITGAARGIGKAIALKFASEGCNIAFTDLVIDENGKQTEEEIAAFGVKVKGYASNAADFEACHAIVAEVVKDFGRLDVLVNNAGITKDGLMMRMSEAQWDAVIAVNLKSAFNFVHAATPVMMRQRSGSIINMASVVGVHGNAGQSNYSASKAGMIGLAKSIAQELGPRGVRANAIAPGFIITAMTDALSDEIKEEWAKKIPLRRGGTPEDVANIATFLASDLSSYVSGQVIQVDGGMNM

SEQ ID NO: 708 - protein, 243 aa, Artificial Sequence
  Synthetic
MTDKKVALVTGGSRGIGRACAIELAKAGCDVVINYAGNAEAAAKTVEELKALGSNSESFKFDVSNQAEVDENIAKIVEKYGRIDVLINNAGITRDDLFIRMGEDKWNAVINTNLSSAFYVSKPVVKLMMKQRSGAIVNMSSVVGLYGNAGQANYSAAKAGLIGFTKSLAKELGSRGVRVNAVAPGFIATDMTKDLPNIDEYLKAIALRRMGKAEDIAAAVKFLALDTDYITGQVLEVDGGMII

SEQ ID NO: 709 - protein, 276 aa, Artificial Sequence
  Synthetic
MKTWLITGCSSGFGKNLAETLLSEGEQVVVTTRKPETIQHFAEKYPQTALCLRLDVTKKDTIDSAVKEAIEKFGKIDVLINNAGYCLRGAVEECTEEEIYAEFNTNFFGAVRMIQAVLPHMRKAGSGAIINYSSIAALDTSAGSAFYGAAKCALEGLSCGLRKEVEPLGIKVMVVEPGPFKTDFFDRSIDINPNRIAAYDGTANKRKVKISDLSKVDMKWCDMGRACKLITDIIQRPDTPHHILLGSMAVGIGEKFVKDRAEEIQKWKEASESLDA

SEQ ID NO: 710 - protein, 258 aa, Artificial Sequence
  Synthetic
MEDIMPKNVLIIGATSGIGEATARAFAREGANLILTGRRVERLEALKAEFEATYPNQKVWTFALDVTDMEMVKDVCQAILKSVGQVHVLVNNAGLALGLTAYQDYEEWDLLTMLDTNVKGLMMVTRQILPSMVAANEGHIINMGSTAGIYAYAGAAVYSATKAAVKTFSDGLRIDTIATDIKVTTIQPGIVETDFSQVRFHGDKEKAAKVYQGLEALQAQDIAEAVLYVTKQPRRVQISDMTIMANQQATGFTIHRGE

SEQ ID NO: 711 - protein, 248 aa, Artificial Sequence
  Synthetic
MNKVVLVTGGAQGIGKAIALELAKNHYDVVINYLTSNKAAALLEEEIKKNYDVRVMIIQADVSKEEEVDAMISLIEKKWGGVDILINNAAVDLSNLFHLKTADEFRKTLDVNVVGAFNCSKRVYRHMLDQEYGRIINISSTNGINTYYPMCIDYDASKAALISLSHNLAFEYGPYINVNAIAPGFIGTDNELDGYDEEFLKEEQEKIMVNRYGKPEEVAYLVKFLISDEANFINNTIIRIDGGQKGSC

SEQ ID NO: 712 - protein, 243 aa, Artificial Sequence
  Synthetic
MTERKIALITGGSRGIGLACALELAKAGCDIIINDICEAEKAQSALDEIKACGVNAYFYQFDVSNDEQVQAAVDKMIAEHGKIDVLLNNAGITKDGLFVRMDMEQWERVIKINLTSAYCVTHAVIKHMMKARQGSIINMSSIVGRHGNAGQANYSASKAGLIGLTQTLAKEFGGRNIRVNAVCPGFIQTAMTQDLANIDEYLKAIPMKRLGTPEDIAKVVKFLALDTDYVTGQAIEVAGGLMI

SEQ ID NO: 713 - protein, 276 aa, Artificial Sequence
  Synthetic
MKTWLITGCSSGFGRNLAETLLSEGEQVVVTARNPKTIQHFAEKYPQTALCLRLDVTKKNTIDATVNAAIEKFGKIDVLINNAGYCLRGAVEECTEEEIYAEFNTNFFGAVRMIQAVLPHMRKAGSGAIINYSSIAALDTSAGSAFYGAAKCALEGLSCGLRKEVEPLGIKVMVVEPGPFKTDFFDRSIDINPNRIAAYDNTANKRKVKISDLSKVNIKWCDMGRACKLITDIIQRPDAPHHILLGSMAVEIGEKFVKDRAEEIQKWKEASESLDA

SEQ ID NO: 714 - protein, 258 aa, Artificial Sequence
  Synthetic
MNRIIVVTGGAGGIGRCIVAHFASQGDSVYFIDQNQQATLAQMEKMRKKGWQVTGFVGDVAEKQDLEEFVALVLREHPEGIHCLINNACLMRGGILSDCDYEDFLYVQRVGVVAPYMLARLFKDHFQGMGAIVNISSTRAFQSQPDTESYTAAKGGITALTHALAVSLSGIARVNSIAPGWIDTGAYHDDTNYESVYSAGDTAQHPSGRVGEPADIARMVDFLCDERNSFINGENIMVDGGMSRLMVYHNDCGWTYEP

SEQ ID NO: 715 - protein, 248 aa, Artificial Sequence
  Synthetic
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNYGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 716 - protein, 243 aa, Artificial Sequence
  Synthetic
MTERKIALVTGGSRGIGLACALELAKAGCDIIINDICDAEKAQPALDEIKACGANAYFYQFDVSNPEAVQENVDKMIAEHGKIDVLLNNAGITKDGLFIRMDMEQWERVIKINLTSAYCVTHAVIKYMMKARQGSIINMSSVVGLHGNPGQANYSASKAGLIGLTKTLAKEFGSRNIRVNAVCPGFIQTAMTANLPNIDEYLKAIPMKRLGTPEDIAKTVKYLALDADYVSGQAIEVAGALII

SEQ ID NO: 717 - protein, 276 aa, Artificial Sequence
  Synthetic
LPTTTPMCSRTSSNCEVANMRKTVLITGASGGLGLEFARIYAREGFDLVVVARSEGKLYKLKSELEAQYDCHVWVLAQDLSQPDAAYEVFNYTLEKNITIDALVNNAGFGDFGNFWEVDAQRQTDLLQVNIMTLVQLTRYFLPGMVERRHGSVLNLSSVAAFSAGPRMCLYYASKEFVRSFSEAVAEEVRSTGVTVTALCPGPTATGFEQAAQMKNSHMFSMFKPASAAAVAEAGFRAAQKGKTLRYCGWPTHTVSIAARLLPRSVCRRFMMKVNG

SEQ ID NO: 718 - protein, 254 aa, Artificial Sequence
  Synthetic
MRLDGKIALITGGGTGIGLDIAKRYVEEGAYVYITGRREKKLQEAVDLVGKNIAYIVADVTKKEDNQKVADRIKADKGHLDIAIANAGVGNYIAIEDVTEEEFNRVMYTNVLGTYYLAQACLPIMKEGSTFILNTSVTTSLGLPKFSLYIAAKSAMKSFIHTWTNELRDRKIRVNALAPGIIPTDAAGQELGRDPKEEQNVQQYRSTLIPAGRVGNVKDTSNAAVFLGSDESSYVNGVELLVDGGLAAIYPVKL

SEQ ID NO: 719 - protein, 248 aa, Artificial Sequence
  Synthetic
MGLLTGKTAIVTGAARGIGKAIAMKFASEGANIAFTDLVIDENGKNTEAEIAALGVKVKGYASNAASFEDTAKVVEQIKEDFGTIDILVNNAGITKDGLMMRMSEGQWDAVINVNLKSAFNFIHACTPIMMRQKSGNIINMASVVGVHGNAGQCNYSASKAGLIGLAKSIAQELGSRGIRANAIAPGFIITDMTAKLTDEVKAEWTKKIPLRRGGTPEDVANIALFLASDLSSYVSGQVIQVDGGMNM

SEQ ID NO: 720 - protein, 243 aa, Artificial Sequence
  Synthetic
MPTVFITGASRGIGRVAALLFAGQGYLTAVNYNRSEAEALSLIDEIRSFGGHAVAIQGDVSDFTRCAEMIKKAEDAFGPVDTLINNAGISCDKIFTDTSPEDWSRTFAVNVGGAYNCCRAVLPGMISRKRGSIVNVSSMWGVTGGSCEVAYSASKAAVIGLTRALAKEMGPSGIRVNCIAPGVIDTDMNARLSADDMAALAGETPLCRIGTPEEAAEAIFYLASDKARFITGAVLNVNGGIVI

SEQ ID NO: 721 - protein, 276 aa, Artificial Sequence
  Synthetic
MRDYFEGRFEGKNMLVTGGTSGIGKSVCIRAAKEGAFVIVVGRNEERGQSVVNEIVENGGNARFIKVDVSREDEVINLFNVINNEIGDIHVAINNAGIVGHGERIDELSTEEWLRVINTNLNSAFYCCREEAKNMLKHKQGGSIVNISSIAGSTGFYRSSAYVSSKHALNGLTKAVANDLAAFNIRCNSVSPAGTATPLNDRSAEEIKGKIGAAMAQGKSIEEAKSETMIGGKTETLQKRSATAEEQAATILYVASEEAAHITGSIIMSDGGYTAY

SEQ ID NO: 722 - protein, 258 aa, Artificial Sequence
  Synthetic
MKDKFTLITGGSEGIGFELAKLFANDNNNILLVARNNDKLNEAKEYLKKNYDVDVITISLDLSVDNSCEKLFEFVEENNLIVDNLINNAGIGSFGFFHEEDNGFEDKIIDLNIASLTKITKYFLRQMIKRKSGGILNVASTAAFVGGPKMALYYATKSYVLTLTEAIHDEVQEYGVKVSCLCPGPVKTSFQSKAGIKKSESAKKYLMNSEDVAKIGYANYKKGKTIIVPGIKNKVLVIGNKLIPRALSRRVVLKSNKY

SEQ ID NO: 723 - protein, 248 aa, Artificial Sequence
  Synthetic
MKLLEGKVAVVTGAARGIGKAIALEFAKQGADVAFTDLTIDDNGKATEQELTALGVRAKGYASNAANFDDTHRVVEEIVRDFGRIDVLVNNAGITKDGLMMRMTEAQWDAVLNVNLKSAFNFIHAVVPVMARQRSGSIINMSSVVGVSGNAGQCNYSASKAGMIGLAKSIAKEMGPRGIRANCIAPGFILTDMTAQLPDEVKEGWYKQIPLRRGGTPEDVARLALFLASDLSSYVSGQVIHCCGAMNC

SEQ ID NO: 724 - protein, 243 aa, Artificial Sequence
  Synthetic
MRKTVLITGASRGIGRATAVAFAKEGYNLVITCSKSETELLRLKEELERDFSVDVLASIGDISDYEYVTQLFSHIEERFHGVDVLVNNAGISYVGLLTDMTIEEWNHIVGVNLTSVFSTCKLAIPHMLSKKSGKIINISSVWGNVGASCEVAYSACKGGMNSFTRGLAKELAPSNIQVNAIACGCIDTQMNACFSEEERAALADEIPAGRFGAPEEVASLALTLAKENEYLTGQIITLDGGWI

SEQ ID NO: 725 - protein, 276 aa, Artificial Sequence
  Synthetic
MTGGGKRQRPLLSALPLEDNIMKKVAIVTGSSRGIGYAIARRLGRDGFRVIVSATGPQEKYEQALAGLTADGTEWRYIRCDIADHDSRLHLIEETVRQFWRIDVLVNNAGVAPKVRADLLDMTEESFDRVVGTNTKGNLFLTQAAAKQMLRQELIGKKRGTIINISSCSAEVSSVSRGEYCVSKAGVSMLTTLFADRLAGEGILVNEIRPGVIATDMTSAVTGKYDKLIADGAFPIARWGTPEDIANAVSAFANDDFLYTTGSYLDVDGGFHIKRL

SEQ ID NO: 726 - protein, 258 aa, Artificial Sequence
  Synthetic
MKNKFTLITGGSEGIGFELAKLFAKDNNNIFLVARSNDKLNKAKEYLKKNYNVEVITISLDLSVDNSCEKLFKFVEENNLVVDNLINNAGIGSFGFFYEEDNGFEEKIIDLNITSLTKITKYFLRQMIKRKSGGILNVASTAAFVGGPKMALYYATKSYVLTLTEAIHDEVKEYGIKVSCLCPGPVKTSFQNKAGIKKSESAKKYLMTAEDVARIGYANYKKGKTIIVPGINNKVLVIVNKLIPRALSRKVVLKSNKY

SEQ ID NO: 727 - protein, 248 aa, Artificial Sequence
  Synthetic
MMETIEKTALVTGASRGIGRAIALTLAAKGYAVALNYAGSQAAAEAVKGEIEAAGGKAFTIQGDVSKAEDVDRIFKTIKEEFGQLDVLVNNAGITRDGLLIRMKEESWDAVLSTDLKSDFLTIKAAAQMMMRKKKGSIINIASVVGIMGNIGQANYAAAKAGVIGLTKACAKELAARNIRVNAVAPGFIATDMTDAIPEKNKEAMLTAIPLGRMGLAEDVAKAVSFLASDDASYITGQVLKVDGGMVM

SEQ ID NO: 728 - protein, 243 aa, Artificial Sequence
  Synthetic
MARKTVLVTGASRGIGKAIAVKFAKKGWNVVISCVKREEQLLQTKKEIESFQVSCLAFLGDMGKMEDCAALFKKIKKQFGGLDVLVNNAGISYIGLLQDMKPEDWDLIVHTNLTSVFNCCRLAVPMMVEKQQGKIINISSVWGICGASCEVAYSATKGGINALTKALAKELAPSNIQVNAIACGAIDTEMNQWLEEEELISLVEEIPAGRLGRAEEVADLVYHLSYKDSYLTGQVIGLDGGWI

SEQ ID NO: 729 - protein, 276 aa, Artificial Sequence
  Synthetic
MSTSTLLHNFLFPPRHLPTDALAKAVLGKTILITGASYGIGEALAHRLAEAGTHLILVARTAERLKALADDLATTGASVRWRSVDLRVEEEVADVITWVRANYSHLDALILNAGKSIHRAFYDSLDRYHDVTRTITTNYTSSVQLIMGLATLLPNGSGQLIASNAASTLMPPAPGWSAYQASKSALDSYLRAIRPELRQRGVVVSLLYLPLVRTRMIAPTEMYRSAPALTPEEAAERIASLLCSRRASFIPWWVRLARPFMPLLRPVVQSIAMRHL

SEQ ID NO: 730 - protein, 258 aa, Artificial Sequence
  Synthetic
MAEVAEKNIRKGVKLMSKVILVTGASRGIGADITQYLAKQGYIVILNYNKSEEEAKKIQSTLAEQNINIDIFKADVTNHFEVTKLVNFCINKYHKIDVLINNAGISQTKLFTDISDLEWNNMLQTNLTSAFYTTKDTLPSMIHNKSGCIINISSVWGLVGSSCEVHYSVAKAGLDAMTKSLAKELGPSNIRVNSIAPGIINTDMNRHLSKEDLQNITQEIPLERIGNPQSITKCVQWLIEDDYTTGQIISINGGWVIT

SEQ ID NO: 731 - protein, 248 aa, Artificial Sequence
  Synthetic
MGLLTGKTAIVTGAARGIGKAIALKFASEGANIAFTDLMIDENGQNTEKEIAALGVKVKGYASNAASFEDTAKVVEQIKEDFGSIDILVNNAGITKDGLMMRMSEAQWDAVIGVNLKSAFNFIHACTPIMMRQKSGNIINMASVVGVHGNAGQCNYSASKAGMIGLAKSIAQELGSRGIRANAIAPGFIITEMTAKLSDEVKAEWNKRIPLRRGGTPEDVANIALFLASDMSSYVSGQVIQVDGGMNM

SEQ ID NO: 732 - protein, 243 aa, Artificial Sequence
  Synthetic
MQLKNKNIFITGSSRGIGLAIAHKFAQAGANIVLNSRGAISEELLAEFSNYGVKVVPISGDVSDFADAKRMVEQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVANRNIRVNAIAPGMIESDMTAVLSDKVKDAMLAQIPMKEFGQAEQVADLTVFLAGQDYLTGQVVAIDGGLSM

SEQ ID NO: 733 - protein, 276 aa, Artificial Sequence
  Synthetic
MKTWLITGCSSGFGKNLAETLLSEGEQVVVTARKPETIQHFAEKYPQTALCVGLDVTKKDTIDAAVKEAIEKFGKIDILINNAGYCLRGAVEECTEEEIYAEFNTNFFGAVRMIQAVLPHMRKAGSGAIINYSSIAALDTSAGSAFYGAAKCALEGLSCGLRKEVEPLGIKVMVVEPGPFKTDFFDRSIDINPNRISAYDNTANKRKVKITDLSKIDMKWCDMGRACKLITDIIQRPDAPHHILLGSMAVEIGEKFVKDRAEEIQKWKDASESLDA

SEQ ID NO: 734 - protein, 257 aa, Artificial Sequence
  Synthetic
MNRIALITGATSGIGEACARKFAGSGYDLVLTGRNKEKLEAMKAELEGVEVTTLAFDVRDRKAAQEALDSLTGRWRDIDVLVNNAGLALGLDKEFEGDIDEWSTMIDTNIKGLLTMTRLVVPHMVERNHGHVINIGSVAGDQAYAGGNVYCATKAAVKALSDGLRIDLVDTCVRVTNVKPGLVETNFSVTRFRGDKSKADSVYAGIHPLNGDDIADVVLYAANAPEHVQIAEVLVLATHQANGYTFSKDTSRVEHLS

SEQ ID NO: 735 - protein, 248 aa, Artificial Sequence
  Synthetic
MDFSGKNVWVTGAGKGIGYATALAFVEAGAKVTGFDQAFTQEQYPFATEVMDVADAAQVAQVCQRLLAETERLDVLVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 736 - protein, 243 aa, Artificial Sequence
  Synthetic
MKRIAIVTGASRGIGREIAKMLAKEDIQVIANYNNSEKKAIELKEELKKENIDIDIFKADISKREDARKLVEYTLKKYKKIDILVNNAGISEYKMFTEETDSDWNRVINNNLYSAFVMCQEVIPNMIHNKNGNIINISSVWGMVGASLEVIYSISKAGMDGLTKALAKELGPSNIRVNSIAPGAIDTDMNEQLSKEELKQLEEDTPLGRIGLPQDIAKCVKWLIEDNFTTGQIISVNGGWIIT

SEQ ID NO: 737 - protein, 276 aa, Artificial Sequence
  Synthetic
MAKTWLVTGTSTGFGKELATLLAQKEDVNVVATARNLAQLDYLDQFDHGQIKKVLLDVTNQAEIQMAVKEAVAAFGGIDVLVNNAGLGYFATFEESNRDQIRYMMDVNVWGLADMTRAVLPIMRKQNHGVIVNFSSIGGLYSFPTLSFYHATKYAVEGLSESLAKEVAKKGIKVLLIEPSGFRTDWAGRSSQKDLPTIADYSEYKEFIEANANGAHHEAGDPKKAAEIIYQQVTDNYDDLPLRLPLGKISSDLAIEKYQENLDQFKQLRERAVTIC

SEQ ID NO: 738 - protein, 257 aa, Artificial Sequence
  Synthetic
MNKTVLITGATSGIGYEFSKIFMENNYDVILVGRNLEKLMELEGFSKKKSVRAYIYKFDLSLSENIDILYKKIKTEVGKVDILINNAGIGFNGEFNEIDWQKQLDIINVNIISLTKLTKLILKDMIDQKEGKILNVASTGAYQPGPLISVYYASKAYVLSFSEALREEVKGKGINVITLCPGATKTNFSKRAGKGDLDVAMSAKEVAEYGYKALIKNKAICIPGFMNKVLVFLSKLSPTTLNAKIVKKIQNKAISKK

SEQ ID NO: 739 - protein, 248 aa, Artificial Sequence
  Synthetic
MNKVVLITGGAQGIGKAIALELAKNHYDIVINYLTSHEAAKKLKEEIINTYSVRCITICADVSNVEQVNQMVTEIEEKLGGVDILINNAAIDLSNLFHLKTNEEFKKTLDVNVVGSFNCAKRVYKHMLEKEYGRIINISSTNGINTYYPMCIDYDASKAALISLTHNLAFEFAPYVNVNCIAPGFIGTENELDGYDEEFLKEEVEKIMVNRYGDPKEVAYLVKFLISDEANFINNTVIRIDGGQKGSC

SEQ ID NO: 740 - protein, 243 aa, Artificial Sequence
  Synthetic
MPRKTVLVTGASRGIGKAVAIKFAKKGYNVVISCVHRAEQLEQTRREIESFQAPCLAYLGDMGDLKSCETLFSQIRSRFGGVDVLVNNAGISYIGLLQDMSSEDWERMLHVNLTSVFNCCKLAIPYMVRQKQGKIVNVSSVWGVVGASCETAYSATKGGINALTKALAKELAPSNIQVNAVACGAIDTEMNQWMEEDELIALVEDIPAGRLGSAEEVADLVYHLGYKNAYLTGQVIGLDGGWI

SEQ ID NO: 741 - protein, 276 aa, Artificial Sequence
  Synthetic
MNTYRTENYIQGKVVVITGASSGFGKETAKKAAELGGKVVLAARRDNLLKEIVQEIREAGGEASYIKTDVRVKEQVEAMIRFAVDTYGAVDVLVNDAGTMPLAWFHEHEQAMEAWEQSIATAINGTLYGISAVYDQMIKQGHGHVVNISSILGNTATEGCGVYNVTKAAVRMLGDSLRIESRGKIKVTNIKPPSVAATGLVATEVDYNAGLAGVYSKIINAFTQLGTSGLDDPESMKCFDFGPSIMADNIIYAINQPWGVDISELTIRATNETMFV

SEQ ID NO: 742 - protein, 257 aa, Artificial Sequence
  Synthetic
MDLNGKRILITGASSGLGRELAYQFSRKGNVDLILVARRKEALDKVAKKCESLGKVTTETYSVDMSSQEEVEGLLQNVSEIDILINAAGYGLMKDYNEFSDHEVVKMFDTNVIGTIQLTSEIAKEMQERKAGSIVTIASLAGKIATPKTSVYSATKFALIGYFNALRLELKKDNVHVMTVNPGPVATNFFNIADKDKTYIKALGNKSLTPKLVASKIIRGIEREKREVNLPFIYTLGVKISQLFPRLSDRILMNMFK

SEQ ID NO: 743 - protein, 248 aa, Artificial Sequence
  Synthetic
MGLLTGKTAIVTGAARGIGKAIALKFASEGANIAFTDLVIDENGQNTEKEIAALGVKVKGYASNAANFEDTEKVVNQIKEDFGSIDILVNNAGITKDGLMMRMSEAQWDAVIAVNLKSAFNFIHACTPIMMRQKSGSIINMASVVGVHGNAGQCNYSASKAGMIGLAKSIALELGSRGIRANAIAPGFIITDMTAKLSDEVKTEWAKKIPLRRGGTPEDVANIATFLASDMSSYVSGQVIQVDGGMNM

SEQ ID NO: 744 - protein, 243 aa, Artificial Sequence
  Synthetic
MDIKNKNVFVTGSSRGIGLAIAHRFASLGANVVLNGRSEISVELLDSFKDYQVKVAAISGDVSQFDDAKRMVDEAIAKLGSVDILVNNAGITHDKLMLKMTEADFESVLKVNLTGAFNMTQSVLKPMTRARQGAIINLSSVVGLTGNVGQANYAASKAGLIGFTKSVAREVAARGVRVNAIAPGFIESDMTDAIPEKMQEAILAGIPMKRIGKAEEVATVASFLAEQEYLTGQVIAIDGGMAM

SEQ ID NO: 745 - protein, 275 aa, Artificial Sequence
  Synthetic
MKRTWLITGVSSGFGYEMTKLLLESGNTVIGTVRSVAKVAGLIEKYPSTFDCCILDICDVESLHAVVGKSFAKHGRIDVIVSNAGYGLFGCAEELSESEINRIIATNLTGSIMLIKYSLPFLRKQGGGNIIQISSYGGQVAYAANSLYHATKFGIEGFCESVAQEVAQFNIRVTIVEPGGARTEFRYGSAKVAALMSEYASCHSFLNMLNASKGLAPGSPVKMAQRIIESVDKSPVPLRIVLGSYALSATLTRLKERIADYETQVELAASTDITE

SEQ ID NO: 746 - protein, 257 aa, Artificial Sequence
  Synthetic
MEIKTVLITGATSGIGKACACKFAKEGWNLILNARDTSKLEKLIYELEMECPKLVTRPLICDVRDREQVKAALENLPADWKTIDLLINNAGLVIGVDKEFEGSLDEWDIMIDTNIKGLLTMTRLVVPGMIERGRGHVINIGSIAGDAAYPGGSVYCATKAAVKALSDGLRIDLVDTPLRVTNIKPGMVETNFSVVRYRGDKQAADNFYKGIRPLTGEDVAETVYFAASAPEHIQIAEVLLMPTNQATGTISYKKKSE

SEQ ID NO: 747 - protein, 248 aa, Artificial Sequence
  Synthetic
MGKVVLITGGAKGIGKTIALELAKNRYDIVINYLTSHQEANCLKEYIIQQYHVRCLALKADVSKEDQVEKMIEEIDNQLGGVDILINNAGIDLSNLFHLKTADEFRKTLDVNVVGAYNCSKSVSAHMLKQDYGRIINISSTNGMNTYYPMCIDYDASKAALISLTHNLAFEFGPYIHVNCIAPGFIGTENELDGYDEEFLKEEQEKIMVKRYGKPEEVAYLVKFLISDEADFINNSIIRIDGGQIGSM

SEQ ID NO: 748 - protein, 243 aa, Artificial Sequence
  Synthetic
MKFKDKTVVVTGSRRGIGLGIALEFAKLGANVVLNGTREIDAETLAQFDAYPGEVMTFVGDVSKFDVAENFINEVKERFGRIDVLVNNAGITRDGLLMRMSESDFDDVMNINLKGYFNMIRFATPVFVKQKSGSIINITSIVGVTGNAGQANYAASKAGIIGLTKSVAKEIGSRGITVNAVAPGYIDTDMTQALPEKIRNEWEKQIPVRRFGTVEDIAEACVFLAEAKYVTGQVLNVNGGLYM

SEQ ID NO: 749 - protein, 275 aa, Artificial Sequence
  Synthetic
MAKTWFITGTSSGFGKELATVVAKNKDTNLVAAARHLEDLAYLDDFDSTRIEKVIIDVTDEAQIKAGVAKALERFETIDVLVNNAGLGYFATIEESDMDQVRYMFDVNVIGLANMTKAVLPTMRAEHAGVIINLSSALALTTLPTMGYYSATKYAVEGYSDTLRQEVANLGIKVMAVEPSGARTQWSGRSSQKVVPAIKDYAAFSDSVANVSDSVTQAPGDPKRIAQVIFDQANASEVPAHLPLGDFAYHGGLQNLEGLVSEIKSREDLSLSTDD

SEQ ID NO: 750 - protein, 257 aa, Artificial Sequence
  Synthetic
MDNKIVLITGATSGIGKACARKFAKEGWDLILNARNASKLEELIYELKVEYPKVVTWSFLCDVRDRGQIEAALEELPPEWTEIDLLINNAGLVIGVDKEFEGSLDEWDIMIDTNIKGLLAMTRLVVPGMIERGRGHVINIGSIAGDAAYPGGSVYCATKAAVKALSDGLRIDLVDTPLRVTNIKPGMVETNFSVVRYRGDKEAADNFYKGIRPLTGDDIAETVYFAASAPEHIQIAEVLLMPTNQATGTISYKKKQE

SEQ ID NO: 751 - protein, 248 aa, Artificial Sequence
  Synthetic
MKLLEGKVAIVTGAARGIGKAIALKFAAEGANIAFTDLVIDENGLATQKEIEALGVKAKGYASNAANFEETHNVVAEIVKDFGRVDILVNNAGITKDGLMMRMSEGQWDAVIGVNLKSAFNFIHACTPVMMKQRSGSIINMASVVGVHGNAGQSNYSASKAGMIGLAKSIAQELGSRGIRANAIAPGFIITDMTAGLPEEVKAEWAKKIPLRRGGTPEDVANIATFLASDMSSYVSGQVIQVDGGMNM

SEQ ID NO: 752 - protein, 243 aa, Artificial Sequence
  Synthetic
MAKKTVLVTGASRGIGKAIAVKFAKKGYNVVINCLHSEERLLQTKKELETYQISCLAYMGDMGDMEQCRILFDQIRKQFGTLDVLVNNAGISYIGLLQDMSTESWDRIIRTNLTSVFNCCKLAVPGMVEKKQGKIINISSVWGVSGASCEVAYSATKGGINAFTKALAKELAPSNVQVNAVACGAIDTEMNRFLEEDELIALIEEIPAGRLGQAEEVADLVYHLGYKNSYLTGQIIGLDGGWI

SEQ ID NO: 753 - protein, 275 aa, Artificial Sequence
  Synthetic
MTKTWLITGVSSGFGYEMTKILLKKGDTVIGTVRNTAKVESLIKQYPDTFDCRLLDVTDVAAVQQTVKESFEKHGKIDVVVSNAGYGLFGCVEELSDEEINHIIATNLVGSIQLLKASVPYMRKQGGGRMIQMSTYGAQVAYPANSMYHATKFGIEGFCEALAQEVAQFNIGVTMVEPGGARTEFRYGSAKVAKLMPEYESCHGFLNMLDASKGLAPGDPVKMAERIIESVDKTPTPLRMVLGSQALDATITRLKERIADYETQTELAASTDVVE

SEQ ID NO: 754 - protein, 257 aa, Artificial Sequence
  Synthetic
MSKTAIITGAAGGLGKGIAERLANDGFNIVLQDINEALLLETEKEFKEKGYQAVAFKSDVSKKKEQEELVQFAVTEFGQLDVMVNNAGVDAVTPILEIGEEELSKLFNINVFGTLFGIQAAANQFIKQKSKGKIINACSIAGHESYEVLGTYSATKHSVRSFTQTAAKELADKGITVNAYCPGVAKTEMWDRIDEEMVKLDDSLEIGDAFEAFSSEIKLGRYQEPSDVANLVSFLASNDSDYITGQSILTDGGLVYR

SEQ ID NO: 755 - protein, 248 aa, Artificial Sequence
  Synthetic
MGKVVLITGGAKGIGRAIALELAKNQYDIVINYLTSNQEAECLKEHIIQQYHVRCLALKADVSKEDQVEKMIQEIDERLGGVDILINNAGIDLSNLFHLKTADEFRKTLDVNVVGAYNCSKSVSAHMLKQDYGRIINISSTNGMNTYYPMCIDYDASKAALISLTHNLAFEFGPYIHVNCIAPGFIGTENELDGYDEEFLKEEQEKIMVKRYGKPEEVAYLVKFLISDEANFINNSIIRIDGGQIGSM

SEQ ID NO: 756 - protein, 243 aa, Artificial Sequence
  Synthetic
MNQRVLITGASHGIGKAAAERFAKEGCTLILNCRQSVEELSALESYLKKNYSVNCISLIGDVSSPDFVKEMFQKTAERFGGVDILINNAGISHIGLLHDMSNEEWQRVMGVNLDSVFYCCREAIPYMLSKKSGSIVNVSSVWGNIGASMEVAYSASKGAVNSFTKALAKELAPSNIRVNAAAFGTIDTRMNSCFSAEERTALEEEIPIGRYGTTEEAAECIYRLATAPAYLTGQILTMDGGWC

SEQ ID NO: 757 - protein, 275 aa, Artificial Sequence
  Synthetic
MKKVWFVTGCSSGLGKSFVKAIAQKGDYVIATARNINTLNDLQSLYPEQVMTYSLDVTNKDQIHQCVQSVLAQFGRIDVLVNNAGYGYRAAIEEGIDEEIDLLFQTNFYGPVHLIQEVLPAMRSQKSGAIINISSIAAVNTFAGSGYYGASKCALEGVSSALKKEVESLGIKVMVVEPGAFRTDFSGRSLKQSHVEIKDYAQTAGLRRIENDHTHGTQMGDPDKGVRLVIEAIESELTPFKLILGEDAWEVYKEREESQNQEMAAWLEKSSLTKF

SEQ ID NO: 758 - protein, 257 aa, Artificial Sequence
  Synthetic
MNNLYGKTIFITGATKGIGRSCALAYAEKGANLILTARSSDLLDSLKEELIRKYGIRVHTLVIDVRNSKDVEDKVKSLPESFKKIDILINNAGLALGLDKVYLASPTDIDTVIDTNIKGMLYVTTAIVPLMLKNNSGYVVNIGSIAGDAAYAGGAIYCASKAAVKTFSDGLRIDLVDSNIRVTNIKPGLVETEFSKVRFKGDLEKANNTYKGIDALTPDDVANVVIYATGLPENIQLTEIAMTPNHQADGRTVHREN

SEQ ID NO: 759 - protein, 248 aa, Artificial Sequence
  Synthetic
MGLLTGKTAIVTGAARGIGKAIAMKFAAEGANIAFTDLVIDENGKNTEAEIAALGVKVKGYASNAASFEDTAKVVEQIKEDFGTIDILVNNAGITKDGLMMRMSEAQWDAVIGVNLKSAFNFIHACTPIMMRQKSGNIINMASVVGVHGNAGQCNYSASKAGMIGLAKSIAQELGSRGIRANAIAPGFIITDMTAKLSDEVKAEWAKKIPLRRGGTPEDVANIALFLASDLSAYVSGQVIQVDGGMNM

SEQ ID NO: 760 - protein, 243 aa, Artificial Sequence
  Synthetic
MQLTNKNVFVTGSSRGIGLAIAHKFAQLGANVVLNSRGAISEELLAEFSNYGVKVVPISGDVSDFADAKRMVDQAIAELGSVDVLVNNAGITQDTLMLKMTEEDFEKVIKINLTGAFNMTQAVLKQMIKAREGAIINMSSVVGLMGNIGQANYAASKAGLIGFTKSVAREVANRNVRVNALAPGMIESDMTAVLSDKVKEATLAQIPMKHFGQAEHIADATVFLAQQDYLTGQVLAVDGGLSM

SEQ ID NO: 761 - protein, 275 aa, Artificial Sequence
  Synthetic
MIDRMKGLKGKTVVVTGASSGIGEALARECAVQGANVVLGARSLQKLQLIVGDIRSKGGEATYCAVDVTRPEECRNLIDTAVGEYGGVDVLICNAGLSMRALFDDVDLEVLHRLMDVNFWGTVYCTKYALPYLQASHGSLVGISSVAGLHGLPGRTGYSASKYAMTGFLETVRIENLKKGLHVMVACPGFTASNVRFSALTADGSSQGETPRDEAKMMTPEQVARIVIRGIEKRKRLCLMEAEGRATHFIKKFAPGFLDRMFYMVMAREPDSPLK

SEQ ID NO: 762 - protein, 257 aa, Artificial Sequence
  Synthetic
MKNKTIAIITGASAGLGKEFVRILAERSELDEIWAIARNEQKLQALTEEYGEKVRTFSKDLSDRKQIKQFGEILQHENVSIQYLINNAGFARFCSYNDLSIEESCNMIDLNINGLVAMGLICIPYMKKGSHLINIASQASFQPLPYQNIYSSTKAFVRNYTRALNVELRDRGIVATAVCPGWMKTDLIDKGLIGADKATSRFRMMVTPDVVAEKAIRDADKNKDISVYGLYVKMAHAVAKILPQRLMMKIWLFQQHL

SEQ ID NO: 763 - protein, 248 aa, Artificial Sequence
  Synthetic
MKLLEGKTAIVTGAARGIGKEIALKYASEGCNIAFTDLVIDENGKKTEEEIAAYGVKCKGYASNAADFAATEQTVEEIKKDFGKIDILVNNAGITKDGLMLRMTEQQWDAVIAVNLKSAFNYIHAVLPIMMRQKSGSIINMASVVGVHGNAGQSNYAASKAGLIALAKSVAQEVGSRGIRANAIAPGFIETAMTEALPAEVREDWCKKIPLRRGGKVEDIANVATFLASDMAGYVTGQVIQVDGGMNM

SEQ ID NO: 764 - protein, 243 aa, Artificial Sequence
  Synthetic
MNQRVLITGASHGIGKAAAERFAKEGCTLILNCRQSVEELSALEFYLKKNYSVGCISLIGDVSSPDFVKEMFEKTMERFGGIDILINNAGISHIGLLGDMSNEEWHRVMGINLDSVFYCCREAIPYMLSKKSGSIINVSSVWGNIGASMEVAYSASKGAVNSFTKALAKELAPSNIRVNAAAFGTIDTRMNSCFSAEERTALEEEIPIGRYGTPQEAAECIYRLATAPAYLTGQILTMDGGWC

SEQ ID NO: 765 - protein, 275 aa, Artificial Sequence
  Synthetic
VNPKRSYLYGAHVIVTGASDGIGKEIVRLLVGRFNCTVLGIARGEEKLAALKTELGGNFRYIVGDVTDVGLWKNISADFDREPCSVLINNAGIMPPFTLALGEPDEELRRVFEVNYFAPVTATRIILPKMKRVCAMPAVVNVCSSSALCPLAATSAYSASKSALKAFTEALAAEEKGKAFVCCVFAGFTKTSLFRKSDGFFDEKKVAKISMTAEKTAQKIVYGMAKRKRRVIIGADAMAMNAFYKLTPANAANVIDSVMKKAHVPSYDAAFEEKE

SEQ ID NO: 766 - protein, 257 aa, Artificial Sequence
  Synthetic
MKKTVLITGATSGIGYEFSKIFMENNYDVILVGRNLEKLMELEDFSKKKCVRAYIYKFDLSLSENIDLLYKKIKTEVGKVDILINNAGIGFNGEFNKIDWQKQLDVINVNIISLTKLTKLILKDMINEKEGKILNVASTGAYQPGPLISVYYASKAYVLSFSQALREEVKDKGINVVTLCPGATKTNFSKRAGKGDLDVAMSAEEVAECGYKALMNNKAICIPGIMNNVLVFLSKVSPTTLNAKIVKKIQNKAISKK

SEQ ID NO: 767 - protein, 248 aa, Artificial Sequence
  Synthetic
MRLKDKVAIITGGSRGIGYATADKFLKEGAAVIVTASTQESADRAVTKLKEKYPDAIVDGISPDLASLESVRNAFKEVTGKYGCVDILVNNAGISESTPFMEYTEETYDKVMDLNVKGVFTATRAAAECMVARSEGVILSTSSMVSISGQSSGFAYPASKFAVNGFTISLARELGPKGIRVNAVAPGITETDMMKAVPREVIEPMIERIPLRRLGQPEDIANAFVFLASDEASYITGVILSVDGMARS

SEQ ID NO: 768 - protein, 243 aa, Artificial Sequence
  Synthetic
MSIAVVTGASGGIGAEIAKRLAQDGFSVALIYNRNAEKAQKTADEITLSGGSAKTYKCDVRDSSEITSAIEAIERDFGEISVLVNNAGISEQKLLTDITDSDWENMISTNLSGAFYFCRAVLPYFVHRKSGRIINISSMWGETGGSCEVHYSAAKAGLIGLTKALAKEVAPSGITVNAVSPGVINTEMVTKLGKDTVDMLREEIPVMRLGTPEDVANIATFLASDMSSYVSGQVIQVDGGMNM

SEQ ID NO: 769 - protein, 275 aa, Artificial Sequence
  Synthetic
MSEKMSEKWIDLSGKVAIVTGGAMGIGEAIVKDLKGCGAKVAIFDMAEPKDYQEDEDTLFIKLNICDRAAVEEAVDQVEKKFGHVDALINNAGVTRPRILVDYYKECPQYELSDADFDFMVGVNEKGTYIMTQTVARKLFEQKSGVIINMSSCAGLMGSRGHSCYSATKAAIHGFTISWAKELGPFGIRVVGVAPDILDRTPANNDEKYRAQAYGRGWPVDTKPEKFFENYKSSIPLGRPGHLSETADLICYLISDHATYITGITIPVSGGKSKG

SEQ ID NO: 770 - protein, 257 aa, Artificial Sequence
  Synthetic
MLSNYVLITGGSDGIGLELAKLFAKDKHNLLLAARNIEKLNKAKEMLKGEGVDVRIISVDLSSMEECEKLINYIEDNNLSVDTLVNNAGIGSFGEFKDISWEKEEALIDINIKALSKLTKHFLPMIIKAKQGGILNVASTAAFCSGPKMAAYYGSKAYVLNLTEAIHEEVKKDGIKVSCLCPGPVKTSFQAKTGIEKSEGAKKYLMEAKDVAKEGYKGFKKGKAIIVPGIKNKLLVNINKFAPRSIVRKIVLKTNEK

SEQ ID NO: 771 - protein, 248 aa, Artificial Sequence
  Synthetic
MRRVVCITGAAKGIGKAIALELAKHNYDVVINYHTSETAALALQKEIQETYQVSCLAIQADVSQEAQVDKMFTQIETQLGPVDVLINNAAIDLSNLFYLKTAEEFRETLDVNVVGAFNCAKRVGHKMLEREYGRIVNIASTNGMNTYYPMCLDYDASKAALISLTHNLAFEYAPYVHVNAIAPGFIGTESELDGYDEEFLQSEQEKILLKRYGNPEEVAYLVRFLISDEANYINNTILRIDGGQVGSC

SEQ ID NO: 772 - protein, 243 aa, Artificial Sequence
  Synthetic
LNQIKTVIVTGASRGIGKAIALSFAKRHWNVVILASKSASDLEKTKQEIESLGAHCLSLLGDVSNPQFVSFVMEETKKRFSTVHCLVNNAGISYIGLITDMSNEDWNQILNTNLSSVFYFSRAVVPMMLQEQDGCIINISSVWGEVGASCEVAYSATKGGINAFTKALAKELAPSHIKVNTISCGAIHTSMNQWLSKEEEDALIDEIPAGRLGEPEEIAEFAYSLTESSYLTGQIIRMDGGWI

SEQ ID NO: 773 - protein, 275 aa, Artificial Sequence
  Synthetic
MKRTWLITGVSSGFGYEMTKLLLESGNIVIGTVRNVAKVAGLIEKYPSTFDCRILDVCDVESIRTVVHKSFAEHGRIDVVVSNAGYGLFGCAEELSENEINRIIATNLTGSIMLIKYSLPFLRKQGGGNIIQISSYGGQVAYAANSLYHATKFGIEGFCESVAQEVAQFNIGVTIVEPGGARTEFRYGSAKVATLMPEYASCHSFLNMLDASKGLAPGSPVKMAQRIIESVDKSPVPLRVVLGSYALSATLTRLKERIADYETQVELAASTDITE

SEQ ID NO: 774 - protein, 257 aa, Artificial Sequence
  Synthetic
MHINGKNIILTGASSGIGLEVLKQLSRYEGVKIIAVARNTSPIPEKEGVIYPYSCDVSNKEGVDKLFLFTETIFDKVDLFIANAGFAYIEKLSSPDWDHIEQIFSLNTISPIYSLEKQIEFNKTGSSFFVSISSAVSTVALPYYSLYCSTKAAIRQFMKTYRFEQSQGVHTMTVYPVATRTEFFKKAHNNTSPPLPFPTQSPITVAKAIMRGIEKDKTSVSPSAVFRLFNYAGNIFPPIFSIYSLLEKRKLEKSDTI

SEQ ID NO: 775 - protein, 248 aa, Artificial Sequence
  Synthetic
MKLLEGKTALITGAARGIGKALALRFAQEGANVAFTDLVIDENGKQTEAEIAALGVKAKGYASNAADFAQTQQVVAQVKEDFGRIDILVNNAGITKDGLMMRMTEQQWDAVIAVNLKSAFNFINAVLPIMMRQRSGSIINMASVVGVHGNAGQSNYAASKAGLIALAKSIAQEVGSRGIRANAIAPGFIETAMTAALPEDIRAEWTKKIPLRRGGQVEDIANVATFLASDMSSYVTGQVIQVDGGMNM

SEQ ID NO: 776 - protein, 243 aa, Artificial Sequence
  Synthetic
MEIKNKNVFVTGSTRGIGKAIALQFAKAGSNLIINGRSAISEELLAEFTAYGVKAVGISGDISKSEDAKQMVAEAIETLGSVDILVNNAGITRDGLSLKMSEEDFESVLKINLTGAFNMTQAVLKPMTRARSGAIINISSVVGLMGNAGQANYAASKAGLIGLTKSIAREVAARNVRVNAVAPGFIESDMTEVLSDKVKDAMKGQIPMKRFGMPEEIATATQFLAEQEYMTGQVLTIDGGVSM

SEQ ID NO: 777 - protein, 275 aa, Artificial Sequence
  Synthetic
MAKTWLITGVSSGFGYEMTKILLEKGDTVIGTVRNTAKVESLIKQYPATFDCRLLDVTDVAAVQQTVKESFEKHGKIDVVVSNAGYGLFGCVEELSDEEINHIIATNLVGSIQLLKTSIPYMRKQGGGRMIQMSTYGAQVAYPANSMYHATKFGIEGFCEALAQEVAQFNIGVTMVEPGGARTEFRYGSAKVAKLMPEYESCHGFLNMLDASKGLAPGDPVKMAERIIESVDKTPAPLRMVLGSQALDATITRLKERVADYETQTELAASTDIVE

SEQ ID NO: 778 - protein, 257 aa, Artificial Sequence
  Synthetic
MGFIMILDLFSLKGKTAVVTGANTGLGQGICVALAQAGASVIGVARRSCADTAEKIAEFNGSFSELIVDLSTPDAVDKIIEGIDSLGGNVDILVNNAGIIKRADALDVTEEDWDTVINLNQRLVFFLSQKIAKKYMVPQKYGKIINIASMLSYQGGIRVPAYTSSKSAIIGMTRALANEWAGLGININGIAPGYMATNNTTQIREDANRNEAILDRIPAGRWGTPEDLCGAAVYLASAASDYVNGFTIAVDGGWLAR

SEQ ID NO: 779 - protein, 248 aa, Artificial Sequence
  Synthetic
MGLLTGKTALITGAARGIGKAIALKFAEEGANVAFTDLVIDENGKATEAEIAAKGVKAKGYASNAADFAQTEEVVKLVKEDFGSIDILVNNAGITKDGLMLRMTEAQWDAVIAVNLKSAFNFIHACVPVMMRQRKGSIINMASVVGVHGNAGQANYAASKAGLIALAKSIAQEMGPKGIRANAIAPGFIDTAMTQALSDEVRKEWAAKIPLRRGGTVDDIAACATFLASDMSSYISGQVIQVDGGMNM

SEQ ID NO: 780 - protein, 243 aa, Artificial Sequence
  Synthetic
MTERKIALVTGGSRGIGLACALELAKAGCDIIINDICDAEKAQPALDEIKACGVNAYFYSFDVSDSEAVQANVDKMIAEHGKIDVLLNNAGITKDGLFIRMDMEQWERVIKINLTSAYCVTHAVIKHMMKARQGSIINMSSVVGLHGNPGQANYSASKAGLIGLTKTLAKEFGSRNIRVNAVCPGFIQTAMTANLPNIDEYLKAIPMKRLGTPEDIAKTVKYLALDADYVSGQAIEVAGALII

SEQ ID NO: 781 - protein, 275 aa, Artificial Sequence
  Synthetic
MKKVWLITGVSSGFGCEMTKQLLENGDTVVGTVRNTKKVKDFIERFPNTFDCKILDVTDMKAVEQTVRDSFEKHGKIDVVVSNAGYGLFGCVEELSDEEIDHIIATNLVGSIALLKIAVPYMRKQGGGRLIQMSSYGGQVAYAANSMYHATKFGIEGFCESLAQEVAQFNIGVTIVEPGGARTEFRYGSAKVAKLMPEYESCHGFLNMLDPANRLAPGDPAKMAQRIIESTEKTPALLRMVLGSQALSATIQRLSERIADYETQKELAASTDIAE

SEQ ID NO: 782 - protein, 257 aa, Artificial Sequence
  Synthetic
MKRLEGKTAVITGGSDGIGLGIAKCFAEEGANLILLGRSEEKLKIAQEALDGYGVKAYAMEADLAQSKTIKGLCERILALPLKIDILVNNAGLGKFVPFEATDEALLDAHLNLNVKAPYLLTQGLLGALAASKGCVINISSYFANRMLVGRTTTAYSITKGALNSFTKSLAFEVGKLGIRVNAIAPGSVLTPQFERNLSALSPQGREAFEQMVQNIYPLGKIGSAQDIGDAAMFLASDAAKWVSGAIFAIDGGLTTN

SEQ ID NO: 783 - protein, 248 aa, Artificial Sequence
  Synthetic
VKALITGASSGIGRDMAKILSKKGYDLVLVARDEEKLQEVKKEIETNSQIISMDLSVEKNCKKLYEQVKDVDLLINNAGFGTCGDFTKTNLDKEINMINTNITAYHILTKLYLKDMKQKDKGQILNVASIAGFMPGPLMATYYATKAYVVRLSEAIREELKKEKSNVKISILCPGPVDTNFNNVADVEFSIKGLSSKYVAKYAVKKLEKNKFYIVPCFSIKCAKIGAKIAPTGLVSKISYKMQKRKIK

SEQ ID NO: 784 - protein, 243 aa, Artificial Sequence
  Synthetic
MSQTVLITGASRGIGRACAAAFARKGYGVAACYHQNEAAARSLLDELSAAGCDAALFRADLSAEAQAVRTAAQALERFGHIDVVINNAGIAQQKLLCDITAEDWARMLGVNVTGMFYICRALLPQMIRRKYGRIVNVSSIWGISGASCEVHYSASKAAVIGFTKALAKEVGPSGITVNCIAPGVIDTDMNAQLDPESLEALRLETPLGTLGTPEDVARLALFLASEGAGFITGQVIAADGGFL

SEQ ID NO: 785 - protein, 275 aa, Artificial Sequence
  Synthetic
MRKIWFVTGVSSGFGYEIARQVLERGDVVVGTVRQSANTQTLAEQYPQTFVRVTLDVRDRKALKNAIGQAVSQFERLDVLVNNAGYGLFGAAEELSDEQIDDVIATNLTGSIATVRAALPFMRAQKSGRIVQISSYGGQVAYAGNSLYHATKFGIEGFCESVAQEIAPFGVKVTIVEPGGARTDFRYRSAHVAELMPEYDDNPAHAFLRMLDPQNGLAAGDPVRMASRIIEAVDDTQAPLRIVLGSQALAATLECLEKRVTELKKQTELARSTDF

SEQ ID NO: 786 - protein, 257 aa, Artificial Sequence
  Synthetic
MDNKIVLITGATSGIGEACARKFAKEGWYLILNARNVSKLEKLIYELKKEYPGLMTYPLLCDVRDRGQMKAALDDLPSEWTGIDLLINNAGLVIGVDKEFEGSLDEWDIMIDTNIKGLLAMTRLVVPGMIERGRGHIINIGSIAGDAAYPGGSVYCATKAAVKALSDGLRIDLVDTPLRVTNIKPGMVETNFSVVRYRGDKEAADNFYKGIRPLTGDDIAETVYFAASAPEHIQIAEVLLMPTNQATGTISYRKKQE

SEQ ID NO: 787 - protein, 248 aa, Artificial Sequence
  Synthetic
MKLLEGKTALITGAARGIGKEIALRFAKEGANIAFTDLVIDENGKKTEEEIAALGVKVKGYASNAADFAQTEEVVKEVHKDFGSIDILVNNAGITKDGLMMRMTEAQWDAVIAVNLKSAFNFIHAVLPIMLRQRSGSIINMASVVGVHGNAGQSNYAASKAGLIALAKSIAQEVGSRGIRANAIAPGFIETAMTAALPEEVRKEWAMKIPLRRAGKVDDIADVATFLASDMSSYVTGQVIQVDGGMNM

SEQ ID NO: 788 - protein, 243 aa, Artificial Sequence
  Synthetic
MLKDKTVIVTGGAKGIGKAIALAFANEGCNIVLNYRSTSPEEVKAEIEAKGVKCFTVQADVSKFDEALKLVEAAKEEFGTIDVLVNNAGITRDTLMMRMSEEDFDAVINTNLKGCFNMMKHASKIMMKQKSGAIINMSSVIGVAGNIGQVNYAASKAGVIGMTYSVAKELAPRNITCNAIAPGMIATDMTDVLADKMKESILSNIPLKRFGQPEEIAETAVFLAKSKYITGQVIRVDGGMVIG

SEQ ID NO: 789 - protein, 275 aa, Artificial Sequence
  Synthetic
VEKKYFANRFDEKVMIVTGAARGIGRAVAIRAAKEGAKVVVVDRLKEEGEETLKVILEDGGDAVFLNLDLSIENSCEEMVKLSVEKFSKIDIAINNAGVMGNPSPVHELSKENMDYTMDNNFYSVYFCCKYELKEFIKNNNGGVIVNNSSIAGLTGLPGNPAYVASKHAVNGLTKNLALDYARFNIRINSVNPAGTDTPMVREAMEFVKARMAEVVAKGIDPAKAQSMAGQKTKTIQQREATAEEQAASILFLASDDATHMTGATVQTDGGWTSF

SEQ ID NO: 790 - protein, 257 aa, Artificial Sequence
  Synthetic
MVTGKLIDLRGKAAVVTGAAAGIGKASAMMLARSGASVALLDRNYDAAALSASEIASECGVQTKAYRCDVLAELDSEAVIEEAARDFGAINILVNNAGGGGGGREIFDGLTDDYLNKIFGLNVYSIFRFSRLCLPHMKRAGYGSIINISSMASVMSSVNMSVYSASKAAVNALTRQMAIDVAPVRVNAVAPGAVKTEALASVLTEEMERKMLASTPLNRLGTPEDIASAVLFFASPMSSWVSGQTLIVSGGGAQVLE

SEQ ID NO: 791 - protein, 248 aa, Artificial Sequence
  Synthetic
MGLLTGKTAIITGAARGIGKAIALKFASEGANIAFTDLVIDENGKNTEAEIAAFGVKVKAYASNAANFEDTAKVVAQIKDDFGTIDILVNNAGITKDGLMMRMSEAQWDAVIGVNLKSAFNFIHACTPVMLRQKSGSIINMASVVGVHGNAGQCNYSASKAGMIGLAKSIAQELGSRGIRANAIAPGFIITEMTAQLSDEVKAEWNKRIPLRRGGTPEDVANIALFLASDLSSYVSGQVIQVDGGMNM

SEQ ID NO: 792 - protein, 243 aa, Artificial Sequence
  Synthetic
MPTVFITGASRGIGRAAALLFAGQGYLTAVNYNRAEADALSLIDKIRSFGGHAVAIQGDVSDFTRCAKMIKEAEDAFGPVDTLINNAGISCDKLFTDTSPEDWSRTFAVNVGGAYNCCRAVLPGMISRKRGSIVNVSSMWGVTGGSCEVAYSASKAAVIGFTQALAKELAPSGITVNCVAPGAIDTEMNAHLTAEERRMLEEEIPLGRMGSPEEVAAAIAFLAGEDARYFTGQVLSPNGGIVI

SEQ ID NO: 793 - protein, 274 aa, Artificial Sequence
  Synthetic
LTASFLQMKHPQTILITGASSGFGKVIATQLAAQGHTVYGSSRKAVSDNPDFKMLQLDITDPVSVSNAISTIIEEQGSIDVLVNNAGMGISGAIELTTEEEIQRQMNTNFTGAVRMCAAVLPFMREAGQGRIINISSIAGVLAVPFQAFYSASKFAIEGYSEALYQEVKPLGIQVCVVEPGDFQTGFTAQRQVCQTSLSHAQYGESFAKAMRNVEQSENNGCRPEKLGKAICKLVNSRHPAFRTKVGPWEQVFFARIKPMLPFCLVDWLIRKFY

SEQ ID NO: 794 - protein, 257 aa, Artificial Sequence
  Synthetic
MVALVTGASSGIGRDIAIELAKRKYDIIAVARNEEALIKLKEEVEKTYNVKVEVKAMDLTDRNGCIKLHEDVKAKYGAIDVLINDAGFGTCGEFTKTDLNKEIGMIDTNIVALHILTKLFLQDMVEVNRGHIMNVASIAGFMPGPLMATYYYSTKAYVVRLTQSIRQELFMKHSKVKISALCPGPVNTNFNKVADVKFNLAEANSKQVARYAVRKMFANKILIFPSFTMWLGRLLFKIIPDQLSAFFCYFAQKRKIS

SEQ ID NO: 795 - protein, 248 aa, Artificial Sequence
  Synthetic
MKLLEGKTALITGASRGIGKAVALAFAKQGANIAFTDLRYDENAQATEKEIEACGVKAKMYASNAADFAQTAATVEEIAKEFGRIDILVNNAGITKDTLLMRMTEEQWDAVINVNLKSVFNFTKAVSAIMLKQKSGSIISMSSVVGVSGNAGQANYSASKAGIIGFTKSVAKELGSRNIRANAVAPGFIITDMTAQLPEDVRKEWAAKIPLRRGGTPEDIADVCTFLASDMSRYVTGQVIHVCGGMNM

SEQ ID NO: 796 - protein, 243 aa, Artificial Sequence
  Synthetic
MAKKVVLVTGASRGIGKAIAVKFAKKGYNVIINCAHREQELMQTKKEIESYQVTCAAFLGDMGDMAVCEQLFSMIRKQFGSLDVLVNNAGIDYIGLLQDMSSEDWDRILRTNLTSVFNCCKLAIPLMLPAGHGKIINISSVWGCAGASCEVAYSATKGGVNAFTKALAKELAPSNIQVNAVACGAIDTEMNQWLQEDELIQLVEEIPAGRLGRAEEVADFVYHLGYKGSYLTGQVIGLDGGWI

SEQ ID NO: 797 - protein, 274 aa, Artificial Sequence; identical to SEQ ID NO: 4
  Synthetic

SEQ ID NO: 798 - protein, 257 aa, Artificial Sequence
  Synthetic
MADYLNNFSLEGKVALITGASQGIGACIAKRLAKDGYNVAINHFPSDSDKANAEKVAEECRSFGVEAELFAANVADYAQCEAMTKAVKERFGSIDALVNNAGITKDGLMVRMSEEQYDAVIAVNQKSVFNMMKLVGAVMMRQRHGHIVSLASVAGLYGNPGQINYSASKAAIIGMTKTVAKELGARNVTVNAVAPGFIKTPMTDALTEEQRNKMLELVAMKRYGNPEEVASVISFLCSEDASYVTGQTIEISGGLMM

SEQ ID NO: 799 - protein, 248 aa, Artificial Sequence
  Synthetic
MKLLEGKVAVVTGAARGIGKAIALRFAEEGASVVFTDLKVDENFQNTEKELQALGVQAKGYASNAADFEDTAAVVAQIVKDFGRIDVLVNNAGITRDGLMMRMSEQQWDMVINVNLKSAFNFIHAVTPVMMKQKSGSIINMASVVGVSGNAGQCNYSASKAGLIGLAKSIAKELGPRGIRANAIAPGFIITDMTNALSDEIKEQWAKQIPLRRGGTPDDVAKVALFLASDLSSYVSGQVIHVCGAMNT

SEQ ID NO: 800 - protein, 243 aa, Artificial Sequence
  Synthetic
VNFKDKKVIVTGGCRGIGKRIAMKFLLLGADVAVTYRTSADSAEEMRLQYPEKLKFYKMDVCQERSVRLTMNQIVEELGGVDVLVNNAGITNDKYLMMMSKEAWDSVLTTNLDGAFLVTKSVLLPMIQQKGGCIINVSSVSGVIGVAGQTNYCASKFALIGLTKALSKEVAGKNIRINAVAPGYIDTDMVQVMPEKHRKEIISKVPMKRLGSPDEIASVVAFLASNDASYITGQTIVIDGGLT

SEQ ID NO: 801 - protein, 274 aa, Artificial Sequence
  Synthetic
MSEKEFFKGKTVVITGASSGIGRALAYEFAANGANVVIGARHDTKLAGIAGDLTNRGAAVAWCAADVTREEDCRRLVETAVARFGGIDILVCNAGISMRALFDNVQLDVLRRLMDVNFWGTVYCTKYALPYLQAARGTVVGVSSVAGLHGLPGRTGYSASKYAMTGFLDTVRIENRRKGVHVMVACPGFTATNVRFSALTADGTEQGATPRKEEKMMTAEEVAHRIAKGIMRRKRLLLMEFEGRATHFIKKFSPRFLDMMFYKVMAREPDSPFK

SEQ ID NO: 802 - protein, 257 aa, Artificial Sequence
  Synthetic
MNNLYGKTVFITGATKGIGRSCALAYAEKGANLILTARSSDLLDSLKEELIRKYGIRVHTLVIDVRNSKDIEDKVKTLPESFKKIDILINNAGLALGLDKAYLASPTDIDTVIDTNIKGMLYITSAIVPSMLKNNSGHIVNIGSIAGDSAYAGGAIYCASKAAVKTFSDGLRIDLVESNIRVTNIKPGLVQTEFSKVRFKGNTEKAKNTYKGIEALTPDDVASVVIYTTGLPENIQLTEITMTPNHQADGRTVHRNK

SEQ ID NO: 803 - protein, 248 aa, Artificial Sequence
  Synthetic
MRLKDKVAIITGGSRGIGFATAKAFLKEGAKVIITASREKTAKEAEENLKALYPEGVVEGIYPELGCFECVKSAFADIAKRYGSIDILVNNAGMSESTSFDDYTDETFDKVMDLNVKGMFNSSKGAAEWMVKQGSGVILSTSSMVSIYGQPSGIAYPTSKFAVNGFTVSLARELGPKGIRVNAVAPGITETDMMKAVPKEIIDPMIAQIPLRRLGQPEDIANAFVFLASDEASYITGVILSVDGMART

SEQ ID NO: 804 - protein, 243 aa, Artificial Sequence
  Synthetic
MAKKVVLVTGASRGIGKAIAVKFAKKGYNVIINCAHREQELMQTKKEIESYQVTCTAFLGDMGDMSVCEQMFSMIRKQFGSLDVLVNNAGIDYIGLLQDMSSEDWDRILRTNLTSVFNCCKLAIPLMLPARHGKIVNISSVWGCVGASCEVAYSATKGGINAFTKALAKELAPSNIQVNAVACGAIDTEMNQWMEEDELIQLVEEIPAGRLGRAEEVADFVYHLGYKGSYLTGQVIGLDGGWI

SEQ ID NO: 805 - protein, 274 aa, Artificial Sequence
  Synthetic
MFKLNTICSIVCNTHERADDIRPCMGIDMIKKILVTGASGGIGSQTAVAFAKCGCDVALHYSKNSEKAESLAEKLTNEYGINAFAVQADVSDYESVCKMFDEIDSRFGNLDVLVNNAGIAQQKLFTDITPDEWKKMTGVNLDGVFYCSQQALKRYMIKNHSGVILNISSMWGQVGASCEVHYSASKAGVIGLTKGLAKEVGLSEVRVNCICPGVIMTDMMKGFDEQTVQELKEETPLNMLGMPDDIAETAVFLCSDRARFITGQIVGVNGGMII

SEQ ID NO: 806 - protein, 257 aa, Artificial Sequence
  Synthetic
MRVFITGASSGIGAALSRAFAARGDTLGLVARNPDKLASFVKTLPFAEKHVPYAVDVTDRTDLLAAARDFEAKGETDIVIACAGISIGVKTEYFEDLDVLERIYKTNVFAMASTFHGFIAPMKSRGRGQFVGIGSVAGIRGLPGSEAYCSSKAAVISYLESLRNDVRPYGISVTTLSPGFVKTPLTAKNPYKMPFLLEPDAFARVAICAIDAKTSYKTIPWQMGVLAKLMRILPNGLFDACVAHRKQKPRDKDLHPN

SEQ ID NO: 807 - protein, 248 aa, Artificial Sequence
  Synthetic
MKALITGASSGMGRDMAKILSQKGYDLILVARDEKKLEEVKKQLKTETKIVVMDISKEENCKKIYEENKDIDILINNAGFGDCGHFEETSLDKDIQMIHTNIIAYHILTKLYLKEMIKKDSGKILNVASIAGFMPGPLMTTYYSTKNYVVRFSESIREELRRKKSKVQISILCPGPVDTNFNKVADVEFALKGLSSEYVAKYAINKFFKGKFYIVPGWKIKLARIGAKLAPASLVAKISYNMQKRKIR

SEQ ID NO: 808 - protein, 243 aa, Artificial Sequence
  Synthetic
MAKKVVLVTGASRGIGKAIAVKFAKKGYNVIINCAHREQELMQTKKEIESYQVTCAAFLGDMGDMAVCKQLFSMIRKQFGSLDVLVNNAGIDYIGLLQDMTSEEWDRILRTNLTSVFNCSKLAIPLMLAAGHGKIINISSVWGCVGASCEVAYSATKGGINAFTQALAKELAPSNIQVNAVACGAIDTEMNQWMEEDELIGLVEEIPSGRLGRAEEVADFVYHLGYKGSYLTGQIIKLDGGWI

SEQ ID NO: 809 - protein, 274 aa, Artificial Sequence
  Synthetic
MSNITWNFKDSVVVITGASTGIGRGTALAFAQAGASVAICDFNETAGAETAQLCREAGAPDARFYKVNVQSEEEVEQAKEQILADFGTVDILFSNAGIFPKDMAHPLEELSDELWQRVFDINFFGAIRVCRAFTPVFKAKKSGKIVVTSSISMNRPNANAMPYCASKVALASLAQSLCLELGPYNGNVNVVCPAYVFTQIYANGGGLKIKADRGGFENCRSDEDVMNQMAKSSALGRAQTPQDIANAVMYLSSDATSEITGQVINVDSGLVFRY

SEQ ID NO: 810 - protein, 257 aa, Artificial Sequence
  Synthetic
MPKNVLITGATSGIGEATARAFAKEGENLILTGRRVERLEVEALKEELQATYPNQKVWTFALDVTDMAMVKDVCQAILKSVGQVHVLVNNAGLALGLTAYQDYEEWDMLTMLDTNVKGLMMVTRQILPSMVAANEGHIINMGSTAGIYAYAGAAVYSATKAAVKTFSDGLRIDTIATDIKVTTIQPGIVETDFSQVRFHGDKDKAAKVYQGVEALQAQDIADAVLYVTKQPRRVQISDMTIMANQQATGFTIHREED

SEQ ID NO: 811 - protein, 248 aa, Artificial Sequence
  Synthetic
MKLLEGKVALITGAARGIGKAIALKFAKEGADIAFTDLVIDENGKATEAEIAALGVKCKGYASNAADFAQTEEVVNAIKADFGKIDILVNNAGITKDGLMLRMTEAQWDAVINVNLKSAFNFIHACVPIMMRQRGGSIINMSSVVGVHGNAGQANYAASKAGLIALAKSIAQEMGPRGIRANAIAPGFIETAMTAALPEEVRKDWMTKIPARRGGQVEDIANVATFLASDMSSYVTGQVIQVDGGMNM

SEQ ID NO: 812 - protein, 243 aa, Artificial Sequence
  Synthetic
MSVALITGATRGIGKAIAIKLSKEGYDIAINYRKENEELNELKKEIEQNNVKCELVQGDVSIFEDTERFVKETIEKLGSIDVLVNNAGITKDMLLMRMKQEDFKQVIDTNLVGTFNVTKNVISYMMKARSGNIVNISSVVGISGNSGQTNYSASKAGIIGFTKSLAKEVASRNIRVNAVAPGFIETNMTDVLKNDIKEEISKNIPLKRMGTADDVANAVKFLVSEESSYITGQVIQVDGGMLM

SEQ ID NO: 813 - protein, 274 aa, Artificial Sequence; identical to SEQ ID NO: 5
  Synthetic

SEQ ID NO: 814 - protein, 257 aa, Artificial Sequence
  Synthetic
MNIIEENIFNLKGKNVILIGASSGIGESIAMALIKYNANVVGTYNSKPISNSFLIKNENFIPYQLNIENISDDYLENLWTFTLSKFKCLPDILINCAGINLHSWIEDYPINDWNKVLDINLTSPFKMCQYFAKKHIEKNSSAKIINISSLTSFQAGKNCTGYTVSKHGLMGLTKILANELGKYNITANCIAPGYIYTDMTSDFLSNSYLSKSYLDRIALGRWGKPEDIQGAAIFLCSDASNYITGSTIIIDGGYLNS

SEQ ID NO: 815 - protein, 248 aa, Artificial Sequence
  Synthetic
MNSLKGKVAIITGAGRGLGRGIALRLAEDGCNIVAADVVPAEETVELAREVGVQADYYVVDVSNQEQVQGLIDFVVEKYGTVDILVNNAGINRDGMLHKITPENWDLVLKINLTGTFYCTQAALRVMRERNYGRIINISSGSWLGNIGQANYAASKAGVVGLTKTAARENAKKGITCNVICPGFIETDMTLRLKEVNDGAAWDSMMARIPMGYAGKPSDVGNLIAFLSSDEASYITSEIINVGGGMIV

SEQ ID NO: 816 - protein, 243 aa, Artificial Sequence
  Synthetic
MAKKVVLVTGASRGIGKAIAIKFAKKGYNVIINCAHRERELLQAQKEISSYQVGCTAFLGDMGKMEDCEKLFALIRKQYGSLDVLVNNAGVDYIGLLQDMTSEDWDRIIRTNLTSVFNCCKLAIPMMLSAGSGKIVNISSVWGNVGASCEVAYSATKGGINAFTRALAKELAPSNIQVNAVACGAIDTEMNQWMEEDEMLQLVDEIPAGRLGTAEEVADFVYHLGYKGSYLTGQVIAMDGGWI

SEQ ID NO: 817 - protein, 274 aa, Artificial Sequence
  Synthetic
MKEDKDMTDYLQNFSLNGKVALITGASYGIGFAIAKAMAGAGATIVFNDIKQELVDKGLAAYKEEGIEAHGYVCDVTDEDAVNGMVAAIEKEVGVIDILVNNAGIIKRIPMCDMSAAEFRQVIDVDLNAPFIVSKAVIPSMIKKGHGKIINICSMMSELGRETVSAYAAAKGGLKMLTKNIASEYGEYNIQCNGIGPGYIATPQTAPLRQVQPDGSRHPFDQFIIAKTPAGRWGEAEDLGGPAVFLASEASNFVNGLVLYVDGGILAYIGKQPK

SEQ ID NO: 818 - protein, 257 aa, Artificial Sequence
  Synthetic
LERTAIVTGARRGIGLAVAEELAQAGFRVVLAAVSPPQEAAGVVARFRENGWTAEYQSVDISKAEDRRGLFDRTEERYGKIDVLVNNAGVAPQVRADLLEMTQESFDRVLSVNLRGTFFMCQEAAGRMIAAKRRGGALYTPRIINIGSISAYTASVSRGEYCISKAGVSMVTSLFASRLAEEGIPVFEVRPGIILTDMTAAVQEKYQRMIEAGITPIRRFGRPKDVADCVMAAVSGRLDFATGQVLNADGGFHLRRL

SEQ ID NO: 819 - protein, 248 aa, Artificial Sequence
  Synthetic
MSRFSGKTALVTGGGAGIGLSIALTLAREGADVIVTGRSESSLAGASTAHHKITTIVADVGKSPNVARIMEHISKDFGRLDILINNAGMAPVTALADQTLTEFDDVFNINVRAVVDLSVQALPLLKASKGCIINISSAVASRPLPGMSVYCATKAALRTLTFVWAKELAKDGIRVNSVAVGPVETPIYEKTELSDEAAKAHRERVTHLVPLGRFGLPQNISSAVACLASDDACFITGSDIAVDGGFSI

SEQ ID NO: 820 - protein, 243 aa, Artificial Sequence
  Synthetic
MYKVAFVSGASRGIGRAIATSLAKEGYHLGLVCRKNQKMLEDLAEDLRSVYHIEVLTFTGDVGDPSFVKALAEEMLAHFSQIDVLVNNAGISHIGLLTDMSVEEWDQILSVNLSSCFYTAKAFVPTMVQKQSGRIINISSMWGNVGASCEIAYSASKGGIHAFTKALAKELAPSRIAVNAIACGVIDTDMNGFLSVEERTALEAEIPAGRFAQPEEVAEAVLQVIKMPTYLTGQVISMDGGYI

SEQ ID NO: 821 - protein, 274 aa, Artificial Sequence
  Synthetic
MVLYLKHTYKTKGLKIIMVAVITGASSGIGKETARLFAAKGWQVICLSRTPCDIKGVKSLRCDITKQEDIDAAFSQIECVDLLINNAGFGVSGCAEFMEMSEIRSQFDLNFFAHVAVTKAALPMLRKSKGRIIFTSSAAAIFSIPFQSFYSATKSAIESLTCALANELKAFGISVCAVRLGDVKTGFTAARQKDFAGDDIYGGMISKSVSVMENDEIHGMKPEEIAAAVMKVAQKKKPPVIVTVGTKYKLFCFLAKILPQNTANKIVGSMYMPK

SEQ ID NO: 822 - protein, 257 aa, Artificial Sequence
  Synthetic
MTDKLIAFVTGSTRGIGKSCAEILLESGYHVVVSSSKEASDIEEVLKEFDSEKYTYVKCDISDAESREKAFSFIEEKFGRLDLLVNNAGVACKKRLDILETTAESVDRLININLKGTFHMCQKAANYMISKLGKIENYQPRIINISSISAYTSSVSRGEYCISKAGISMVTELFADRLAEYSIPVFEVRPGIIMTDMTECVKEKYIKMIEENGITPIRRMGMPEDVAKCVKAAASGLLDFGTGTVLNADGGFHIRRL

SEQ ID NO: 823 - protein, 248 aa, Artificial Sequence
  Synthetic
MIILVTGATAGFGESITRRFVANGHKVIATGRRQERLQELKDELGDSILTAQLDVRNRAAIEEMIANLPAEWRAIDVLVNNAGLALGMEPAHKASVEDWENMIDTNNKGLVYMTRAVLPGMVERNRGHIINIGSTAGSWPYAGGNVYGATKAFVRQFSLNLRTDLHGTAIRVTDIEPGLVGGTEFSNVRFKGDDAKAGKTYENANALTPEDVTETVWWVATLPKHVNINTVEMMPVSQSFAGLSVHRG

SEQ ID NO: 824 - protein, 243 aa, Artificial Sequence
  Synthetic
MPRKTVLVTGASRGIGKAVAVKFAKKGYNVAISCVRREELLMQTQKEIESFQVPCLAYKGDMGNMECCEELFGRIKKMFGGVDVLVNNAGISYIGLLQDMSTEDWERMLRTNLTSVFNCCKLAVPYMISQKQGKIINISSVWGVVGASCETAYSATKGGINALTKALAKELAPSNIQVNAIACGAIDTEMNQWMEEDDLIALVDEIPSGRLGRAEEVADLVYHLGYKESYLTGQVIGLDGGWI

SEQ ID NO: 825 - protein, 274 aa, Artificial Sequence
  Synthetic
MSNLDFKGKLFVVSGASSGLGRILTEKLISDGCKVIGIGRNEAKFVDFKATLGDKSDMLETEIFDVSDEIGWKNLAAKLAARGDALNGLINCAGVFPPFRKAVDFTVSDIESVMKTNFLSAVYAVKNLLPFLEKSGFPTIVNVSSAAALASIVGTSGYSASKSALKTYTEILAEELRGKAYVGLVMPGFARTDIMRSQNTSFDEDKLVKKMSMPADRMAGKIFRGIREKKRRMILGSDAKILNFFYRLMPKTTTRLVAVVLKKSKMKLFADIFE

SEQ ID NO: 826 - protein, 257 aa, Artificial Sequence
  Synthetic
MQLLKGKVAVITGATKGLGAAIAKQLAKQKAIVIITGRCERELSNLCKEIRDNNETCYYKILDVTNSPQIQEVVNETIMEFKRIDIWINNAGISYTANLLETTNEMWNKTLNTNLTGVFECCRETARIMKKQRSGRIVNIASVAASKGLKNYSAYTASKHGVVGITKTMAIELASCGITVNAISPGVVNTDMINDVIHQEAIMEKCDVEKIKKSYLSDIPMGRFAEPEEIAYAVVFLCSDFASYITGINLTIAGGEQ

SEQ ID NO: 827 - protein, 248 aa, Artificial Sequence
  Synthetic
MMRFENKTAVVTGGSRGIGLAIATKLAKEGANIAILYVGDENEGIKAKEELSQYGTKVEQYFCDVSNFEESKKVVDQVIEEFGSIEILVNNAGITRDKLVLNMDEKDFDAVINVNLKGTFNMIKHTYKHFMKKRYGRICSTASIVGLTGNAGQANYSASKAGIIGLTKSVAKELAGRGVTANAVAPGYIATDMTSVLPDKVKDAMKAQIPAKRIGTPDDVADVVAFLCSDDAAYVTGEVIRVDGGLAM

SEQ ID NO: 828 - protein, 243 aa, Artificial Sequence
  Synthetic
MKGLQGKIAVVTGATSGIGKATASELASQGAQIVLVGRSKERGQALQSELGQKTIFMDCDISDWEQVDRLGEKIEQEFGRIDILFNNAGIMLPSKEIAIMTPEDWNATFNVNITGMFYVTRRLKPCMEQMGGCIINNGSIAGMHSYIAGRSYAYSASKAAVIQFSRQMAKNYGPEKIRVNCICPGIIETPILGDRSRDEYASRIPLGYIAQPEEVAKVVAFLASDEASYITGAVIPVDGGASL

SEQ ID NO: 829 - protein, 274 aa, Artificial Sequence; identical to SEQ ID NO: 6
  Synthetic

SEQ ID NO: 830 - protein, 257 aa, Artificial Sequence
  Synthetic
MEKILITGASSGIGKELAKYLANKNKKLYLLARSIDKLNLLKKELEEKFSSLKCICIKYDLTDINNLENIVENCDVDLVINCAGFGKITDFSKLSDKEDLDTINVNFISPLILTKKFSEKFLQKGQGTILNVCSIAALYQHPYMAVYSSTKSALLHYSLALDEELSHKNKNVRVLSACPGPTASNFFDKDIQEKFGSSQKFMMSSEDVAKRIIKVIENKKRFSIIGFRNKLSIFLINLLPISLQLKLVGLILKKVIK

SEQ ID NO: 831 - protein, 248 aa, Artificial Sequence
  Synthetic
MSDFSNKVACITGAAGGMGRAVATELAKRHADLILCDLQESENFTVFIEGLKAEYGVQVYPFYFNLEDEESIKEGLKAIKVLKIKIDILVNNAGMPHLAILPFTKMSDVKKVFQVNYFAQLQITQSLLGIIKKNENSSIINLSSIAGIDGDIGNSVYGATKASMALFTKVLSKELTSSHIRVNAVAPGLTNTNFATMMGQKAIESMEQISTMGRLGNPQEIANTIVFLASDEASFINGQIIRIDGGLK

SEQ ID NO: 832 - protein, 243 aa, Artificial Sequence
  Synthetic
MDRAVLITGASRGIGAAIAEVFARHGYQLILNCCHSETALKALSDELSDKYHVTVLPVIGDVSDPDFIANMFAMIHQQSLSVDVLINNAGISHIGLLQDMTYEQWQHVINTNLSSVFSCCKYALPDMLHKKSGRILNISSVWGNVGASCEVAYSASKGAVNSFTKALAKEVAPSGISVNAIACGTIDTSMNACFSAEERADLESEIPCGRYGTPVETAELAYAIVSQSPYLTGQIITLDGGWC

SEQ ID NO: 833 - protein, 274 aa, Artificial Sequence
  Synthetic
LFYWFVGGKIKMRKAYTLITGASEGIGKELAELFAKDGHNLILVARNEKKLLGVKKKLEKRYGIGVVVIVLDLSKQNAAEKLHAYTTQKQYVVDYLVNNAGFGDWGEFLEADWERQNEMVQVNLFALMRLTYLYGRDMKKQKKGRILNVASAAAFCAGPYMSVYYASKAFVLSFSQAIHEEAKKYGVSVTALCPGPTKTGFETTAQLKNSKMFTLLPVESAKAVAKCGYKAMRKGQPLAYSGLVTKYGNVASCIVSKRIARKVAKQINGKPKRV

SEQ ID NO: 834 - protein, 257 aa, Artificial Sequence
  Synthetic
MLRREQNLNVSEKTILITGGAGGLGSAMARLLAVNGATVVILDMDRDKGEQLVAELAQSGAKAYFQRIDVTSEEDWKRAVDDAVKETGRVDVLVNNAGINIRKPVEEMSIDEWQKMMAVNTGSVFLGCKYVIPVMRRQGGGVIINTSSVCGLIGHKYTTEAYTATKGAVTMLTKAIASRYAKDNIRCNSIHPSTVYTPFIEVLFKDPARREERLGEVPLGRLASDMDVANAVLYLASDEASFINGVALPIDGGVTCC

SEQ ID NO: 835 - protein, 248 aa, Artificial Sequence
  Synthetic
MGLLTGKTAIVTGAARGIGKAIALKFAAEGANIAFTDLVIDENGQNTEKEIAAFGVKVKGYASNAANFEETEKVVNQIKEDFGSVDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITDMTAKLSEEVKAEWCKKIPLRRGGTPEDVANIATFLASDMSSYVSGQVIQVDGGMNM

SEQ ID NO: 836 - protein, 243 aa, Artificial Sequence
  Synthetic
MSKVIIITGASRGIGRETTKLLARNGHTVIANYNKSEEKAKELQEELKKENINIDIFKADVSKREECKALVQYAIDKYKHIDVLVNNAGISIWGQFTDLTDAEIEEIMRVNLYSAIAMSQEVSKHMIHQKEGCIINISSIWGMVGASCEVAYSITKAGIDGLTKSLAKELGPSNIRVNSVAPGAIETDMNSNLTDEEKKVLEMETPLGKIGKPCDIAKAINWLVEDEFTTGQIISPNGGWVIC

SEQ ID NO: 837 - protein, 274 aa, Artificial Sequence
  Synthetic
MEKTIVITGASGSMGSAAVKALAKKGFGVIMACRNLSKASAVREDILREVPQAKLELAKLRLDSFASIREFALSLNDRKLYGLFNNAGVMPKDYTLTGDGYEQTMAVNYLGPFLLTHLLFPNLEGDGHVVNMVSLTCNHVKEPSDFINVRPEDYHQLHNYAISKLALMYFSIELARRESDLNVNVADPGVVNSNMIDLGRWFDPIADTVFKPLCKTPAEGALPAVNAMLSDRSMQLFRGDGYEPIPDKFLERRISSAALWEQTESIFRDMYQED

SEQ ID NO: 838 - protein, 257 aa, Artificial Sequence
  Synthetic
MEYYADLQGKIAIVTGASAGMGKAISEKYLQAGMKVIGTGRRKEKLESSVKELPIELQQNFVPFCGDVGRSEDNAALLAMVKDEFGRLDVLVNNAGVMDRMTPVGDVSDELWHHVMDVNINGPFELCRGAVNMMLEKEKGNIINIASGGGIGGGRSGAAYVASKFALVGLSKNIAYMYAMKGIRCNCICPGGVATEIGSDAGEYHPLGVERVMMAGTKMIRMGEAPEIGEIALFLASDRSSLLNGIALPADAGRSAW

SEQ ID NO: 839 - protein, 248 aa, Artificial Sequence
  Synthetic
MKLLEGKTAIVTGAARGIGKEIALRFAREGANIAFTDLVIDENGKKTEEEIAALGVKVKGYASNAADFAQTEEVVKEIHKDFGSIDILVNNAGITKDGLMMRMTEAQWDAVIAVNLKSAFNFIHAVLPIMLRQKSGSIINMASVVGVHGNAGQSNYAASKAGLIALAKSVAQEVGSRGIRANAIAPGFIETAMTAALPDDVRAEWCKKIPLRRGGKVDDIANVATFLASDMSSYVTGQVIQVDGGMNM

SEQ ID NO: 840 - protein, 243 aa, Artificial Sequence
  Synthetic
MTERKIALVTGGSRGIGLACALELAKAGCDIIINDICEAEKAQPALDEIKACSVNAYFYRFDVSNDEEVQANVDKMIAEHGKIDVLLNNAGITKDGLFIRMDMEQWERVIKINLTSAYCVTHAVIKHMMKARQGSIINMSSVVGLHGNPGQANYSASKAGLIGLTKTLAKEFGSRNIRVNAVCPGFIQTAMTANLPNIDEYLKAIPMKRLGTPEDIAKTVKYLALDADYVSGQAIEVAGALII

SEQ ID NO: 841 - protein, 273 aa, Artificial Sequence
  Synthetic
MRPEYFKDKVVIITGASSGIGLASARLLGSFGADVVMAARSLDKLQELAPSVNSDPAKVLCVKTDVTKEEDCRNLIDRTVQEYGRIDILVNNAGISMRAMFKDLDLSVIHSLMDVNFWGTVQCTKFALPYLLQSKGQVVGVISIAGFSALPARTGYSASKYAVRGFLDTIRIEHLKDGLNVLVFAPGYTDSNVRKAALTADGSPQGETPLKEEKLMTAEKCAEYLAKGLEKRRSQMILTGLGKVTVLAHRLFPRLTDKLTYGFIAKEAGSPFK

SEQ ID NO: 842 - protein, 257 aa, Artificial Sequence
  Synthetic
MEIKTVLITGATSGIGKACACKFAKEGWNLILNARDTSKLEKLIYELEMECPKLVTRPLICDVRDREQVKAALENLPADWKTIDLLINNAGLVIGVDKEFEGSLDEWDIMIDTNIKGLLTMTRLVVPGMIERGRGHVINIGSIAGDAAYPGGSVYCATKAAVKALSDGLRIDLVDTPLRVTNVKPGMVETNFTVVRYRGDKEAADNFYKGIRPLTGDDIAETVYFAASAPAHIQIAEVLLMPTYQATGTISYKKKTE

SEQ ID NO: 843 - protein, 248 aa, Artificial Sequence
  Synthetic
MKRFENKIVLVTGAGRGIGASIAKRFASEGAEVIVNYSGNDEAAQKTVDEITATGGQAQKYKCSVNDSESVKVMIDEIIKEFGRIDILVNNAGITKDGLMLRMTDEDFDRVIDVNLKGTFNCTKYVSKYMLKQKSGKIINISSVVGLSGNAGQVNYSASKAGIIGITKSAAKELSSRGITVNAVAPGYVDTDMTKVLSDNIRNEILKNIPLQRMGNVEDISNCVAFLASEDASYITGQVISVDGGMHI

SEQ ID NO: 844 - protein, 243 aa, Artificial Sequence
  Synthetic
MNKVALVTGSSRGIGKAIVEDFAKKGYNIVINYIKENEEAENLKQELEKEYEIKALCIKADVSNENEVKDMIRNIINEFGKIDVLVNNAGIAIDKEFEDRTVEDWKKTLNVNLIAPFIVSKYVGKEMLKSKSGKIINISSTNGIDAFFPTSIDYDASKAGLINLTHNLAIQFAPYINVNCVAPGWVNTDMNKDLPKELVEEETNRIYKKRFAEPSEIAKVVTFLASDDADFINDEIIKVDGGY

SEQ ID NO: 845 - protein, 273 aa, Artificial Sequence
  Synthetic
MLSAFVNLKIIFNNEGMVPQLSGKGEVMLTNKTALVTGASRGIGAAIAKSLAKEGAFVIINYNGSKERADAVAAEILADGGKAAVYGCNVSDYSACEKMAKDIIENYGHLDILVNNAGITRDDLLMKMSEEAFDAVIATNLKGTFNTIRHFSRYLLKQRSGTIINLSSVSGILGNAGQANYSASKAGVIGLTKSVARELSSRGITCNAVAPGFIDTEMTAQMTDKAKEAVKTQIPLGRAGKVEDIAEVVTFLASEKASYITGQVISVDGGMSI

SEQ ID NO: 846 - protein, 256 aa, Artificial Sequence
  Synthetic
MRGKIVFITGASSGIGEGCARKFASQGSDVILNARNVAKLEELKKELEKAYDIRVFLLPFDVRDRKAAVDALASLPENWKAIDVLVNNAGLVIGVDKEFEGNLDEWDVVIDTNIKALLAITRLVVPGMVERGRGHIINIGSIAGDAAYPGGSVYCATKAAVKALSDGLRIDLVDTPLRVTNVKPGMVETNFTVVRYRGDKQAADNFYKGIRPLTGEDIAETVYFAASAPEHIQIAEVLVMPTYQATGTISYKKKME

SEQ ID NO: 847 - protein, 248 aa, Artificial Sequence
  Synthetic
MGLLTGKTAIVTGAARGIGKAIALKFAAEGANIAFTDLVIDENGQNTEKEIAALGVKVKGYASNAANFEDTEKVVNQIKDDFGSVDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITEMTAKLSDEVKAEWNKRIPLRRGGTPEDVANIALFLASDMSSYVSGQVIQVDGGMNM

SEQ ID NO: 848 - protein, 243 aa, Artificial Sequence
  Synthetic
MAKVALITGATRGIGKAIAIRLANAGFDIALNYRKENDDLTNTKSEIEKAGVDCLPVQGDISSFEDCERIAKEIFDKFGKIDVLVNNAGITKDMLLMRMKPEDFSSVVDVNLIGTFNMTRNVVPYMVKARSGRVVNISSVVGIEGNAGQTNYSASKAGIIGFTKSLARELGSRNILVNAVAPGFIETDMTAVLSDSVRDEIAKKISLKRMGTAEDIAGVVEFLCGEASSYVTGTVIPVTGGLI

SEQ ID NO: 849 - protein, 273 aa, Artificial Sequence
  Synthetic
MEDKEMADYLNNFSLEGKVALVTGASYGIGFAIAKAMAGAGATIVFNDIKQELVDKGIAAYKEEGIEAHGYVCDVTNEDAVNAMVAQIEAEVGVVDILVNNAGIIKRIPMCEMSAAEFRQVIDVDLNAPFIVSKAVIPSMIKKGHGKIINICSMMSELGRETVSAYAAAKGGLKMLTKNIASEYGEYNIQCNGIGPGYIATPQTAPLREIQPDGSRHPFDQFIVSKTPAGRWGEAEDLGGPAVFLASDASNFVNGLVLYVDGGILAYIGKQPK

SEQ ID NO: 850 - protein, 256 aa, Artificial Sequence
  Synthetic
MKAKIVFITGASSGIGEGCARKFAKEGWNLILNARTVSKLEELKAELEKEYGIQVCVLPFDVRDRKQAAAALEALPEEWKSIDVLINNAGLVIGVDKEFEGSLDEWDIMIDTNIRGLLAMTRLVVPGMVERGCGHIINIGSIAGDAAYPGGSVYCATKAAVKALSDGLRIDLVDTPLRVTNIKPGMVETNFTVVRYRGDKQAADNFYKGIRPLTGDDIAETVYYAASAPAHIQIAEVLLMPTYQATGTISYKKKAE

SEQ ID NO: 851 - protein, 248 aa, Artificial Sequence
  Synthetic
MKLLEGKTALITGASRGIGKAVALAFAKQGANIAFTDLRYDEGAQATEKELAECGVKAKMYASNAADFAATAATVEEVVKEFGRIDILVNNAGITKDTLLMRMTEEQWDAVINVNLKSVFNFTKTVSAVMLKQKSGSIISMSSVVGVSGNAGQANYAASKAGIIGFTKSVAKELGSRNIRANAVAPGFIITDMTAQLPEEVRKEWAAKIPLKRGGTPEDIADVCLFLASDLSRYVTGQVIHVCGGMNM

SEQ ID NO: 852 - protein, 243 aa, Artificial Sequence
  Synthetic
MPRKTVLVTGASRGIGKAIAVKFAKKGYNVVISCVHRQEQLEQAKREIESFQVPCLAYLGDMGDMKSCEELFAKIKTSFGGVDVLVNNAGISYIGLLQDMTAEDWERMLHVNLTSVFNCCKLAIPYMVHQKQGKIINISSVWGVVGASCETAYSATKGGINALTRALAKELAPSNIQVNAVACGAIDTEMNQWMEEEELISLVEEIPAGRLGNAEEVADLVYHLGYKNSYLTGQVIGLDGGWI

SEQ ID NO: 853 - protein, 273 aa, Artificial Sequence
  Synthetic
MKTWLITGCSSGIGKGIAKVALKKGYQVVVTARNTEKLKDLYEAYPKTCLPVSLEMTDKQSIQNVVKVTNEKFGPIDVLINNAGHGYRAAVEEGEEADIEELYDTNVFGPVTLIKEVLPQMRQQQSGTIVNVSSIAAVRSALGSGYYASSKAALELITDALIKEVKPLGIRAMIVEPGSFRTKFYDEALKGTAIKVDDYVKAGVKRREETVNARQQPGDPDKAGEVIVKVIEQDELPHTLLLGSDAVKIVSQELERKLKEIQDYQNISEQTDF

SEQ ID NO: 854 - protein, 256 aa, Artificial Sequence
  Synthetic
MNLNGKIALVTGSTSGIGLGIARVLAKSGAQLILNGFGDSGSAREEIAQLGKKPGYHDADLRDVLQIEAMMRYAESQFGGVDILVNNAGIQHVAPVETFPVEKWNDIIAINLSAVFHTSRLALPAMREQNWGRIINIASVHGLVASKEKSAYVAAKHGVVGFTKSLALETARTGVTANALCPGWVLTPLVQQQIDKRIADGVPPELAQDQLLGEKQPSGEFVTPEQLGELALFLCSDSAVNVRGAAWNMDGGWVAQ

SEQ ID NO: 855 - protein, 248 aa, Artificial Sequence
  Synthetic
MSIENKVVVITGASSGIGAATAKLLASKGAKVVLGARREDRLQELSQTIGDNAVYQVTDVTDRAQVKALIDLAVSKFGRVDVLYNNAGTMPQGNLSDREYDKWQMMLNVNIMGVLNGIGEVLPIMQKQQDGLIIATDSVAGHVVYPASAVYNGTKYAVRAIMEGLRQEEKNHGIRSTIVSPGAVRTELVNTIGNTQIQAGISELMNADDSKGLALNPEDIANAVLFAIDQPKHVAISEVLVRPAQQEV

SEQ ID NO: 856 - protein, 243 aa, Artificial Sequence
  Synthetic
MKNKTIFITGGSSGVGKLLTHELAKDNKIITVARRIDKMKIEFGLNPNVSIFRCDISDMKNVNNLLKSIDALFGEIDVIINCAGIMKSGSVEENKIEDYMYSININALGPLAIVKHYLPRMIKMNYGRIINFTSGAPLNNFAGYSVYSASKAMLNSWTVTLGYELKDTNVLINLMSPGPVRTEMAPDAPMEPEVCLPTVYYLLDEVTTSGGFYWLGHKVPLKPDLEGIDWLHGIGNDKIQKVL

SEQ ID NO: 857 - protein, 273 aa, Artificial Sequence
  Synthetic
MSRNRIVFEGLPLLSLQPTCAIFAVKIQKNMKRRVFVTGGARGIGKGIVEAFTRQGDEVVFCDIDPELGARTAAGTGARFCQLDVTDAAGLEGCMQQLFETLGDIDILVNNVGIGLFKPLDELSIEEFDRVIATNLRPVFITSRQLALHRRRNGNRRYGRIINLCSTRYLQSEAGTEAYSASKGGIYSLTHSLAVSLAPLRITVNAIAPGWIHVREEEPLRSEDHQFHPSGRVGEPGDIARMCLFLCDEANDFLNGQTLTVDGGATIRMIYPE

SEQ ID NO: 858 - protein, 256 aa, Artificial Sequence
  Synthetic
MEAKIVFITGASSGIGEGCARKFAKEGWNLILNARTVSKLEELKAELEKMYGVRVYILPFDVRDRKQAAAALESLPEEWKAIDVLVNNAGLVIGVDKEFEGSLDEWDIMIDTNIRGLLAMTRMVVPGMVERGRGHVINIGSIAGDAAYPGGSVYCATKAAVKALSDGLRIDLVDTPLRVTNIKPGMVETNFTVVRYRGDKEAADNFYKGIRPLTGDDIAETVYFAASAPEHIQIAEVLLMPTYQATGTISYKKKTE

SEQ ID NO: 859 - protein, 248 aa, Artificial Sequence
  Synthetic
MIVLVTGATAGFGECITRRFIQQGHKVIATGRRQERLQELKDELGDNLYIAQLDVRNRAAIEEMMESLPADWRDIDILVNNAGLALGMEPAHKASVEDWETMIDTNNKGLVYMTRAVLPGMVERNRGHIINIGSTAGSWPYAGGNVYGATKAFVRQFSLNLRTDLHGTAVRVTDIEPGLVGGTEFSNVRFKGDDGKAEKTYQNTVALTPEDVCEAVWWVATLPAHVNINTLEMMPVTQSYAGLNIHRH

SEQ ID NO: 860 - protein, 243 aa, Artificial Sequence
  Synthetic
MQSKVVIVTGASRGIGANIVKTLAKKGYNVILNYNTSEKEAITVKQELEEKGIEIEIFKADVSKRQEAKKLIEFALEKFKQIDVLVNNAGISQIKLFTEITDEDWARMINTNLNSVFYCTQEALPNMINNKSGCIINISSIWGITGASCEVHYSVSKAAIDGLTKSLAKELGLSNIRVNSVAPGFIDTDINKNISEQARKEFIEQIPMGKIGQTEDISKCIEWLIEDNYTTGQVISINGGIVI

SEQ ID NO: 861 - protein, 273 aa, Artificial Sequence
  Synthetic
MNKTYFKDKVIIITGASSGIGLASARLFGSCGAKVVMAARHLDKLQAEVPSVSDDPDNVLCVKTDVSKEEDCKMLINKAVEKFGRIDILVNNAGISMRAMFKDLDLSVIKSLMDVNFWGTVYCTKYALPYLLHSKGSVVGVISIAGYSALPARTGYSSSKYAIRGFLDTIRIEHLKDGLNVLVFAPGYTASNVRNAALTADGSAQGETPLDEGKLMSAEECAEHLAKALAKRKSEVILTGLGKATVLAHRLFPRLTDKMTYKFIAREKDSPFK

SEQ ID NO: 862 - protein, 256 aa, Artificial Sequence
  Synthetic
MEAKIVFITGASSGIGEGCARKFAREGWNLILNARTVSKLEELKAELEATHGVRVYILPFDVRDRKLAAASLESLPEEWKAIDVLVNNAGLVIGVDKEFEGSLDEWDIMIDTNIRGLLAMTRLVVPGMVERGRGHIINIGSIAGDAAYPGGSVYCATKAAVKALSDGLRIDLVDTPLRVTNVKPGMVETNFTVVRYRGDKEAADNFYKGIRPLTGDDIAETVYFAASAPAHIQIAEVLLMPTYQATGTISYKKKPE

SEQ ID NO: 863 - protein, 248 aa, Artificial Sequence
  Synthetic
MGLLTGKTAIVTGAARGIGKAIALKFAAEGANIAFTDLVIDENGLNTEKEIAALGVKVKGYASNAANFEDTAKVVEQIKEEFGSIDILVNNAGITKDGLMMRMSEAQWDAVIAVNLKSAFNFIHACTPIMMRQKSGNIINMASVVGVHGNAGQCNYSASKAGMIGLAKSIAQELGSRGIRANAIAPGFIITEMTAQLSDEVKAEWNKRIPLRRGGTTEDVANTALYLASDLSAYVSGQVIQVDGGMNM

SEQ ID NO: 864 - protein, 243 aa, Artificial Sequence
  Synthetic
MKNKIIIITGGASGIGLATAKKLSIDNKVIIADYKDINQDFIKENFTNIDNVYYFKCDISKKENIMSLRDFVQEKFDKLDCLVCNAGILPLPCGIDTITDDSIDRTIDVNLKGTFKCLNILGNFIKETSKTGSIVNISSVDGLIGEPYGVIYSTTKAGIISLTKSFARYFKGDIRVNCVAPGLIDTPLTDSTGEDPSWTTDYSIIKRIGKPEEIADSIIFLLSDKSSFITGQVLAVDGGFTLK

SEQ ID NO: 865 - protein, 273 aa, Artificial Sequence
  Synthetic
MDKNCFQNKVIIITGASSGIGLASARLFGSYGAKVVMAARHLDKLEAEVPSVSPNPDNVLCVKTDVSKEEDCKALIEKTVEKFGRIDILVNNAGISMRAMFKDLDLSVIKSLMDVNFWGTVYCTKFALPYLLQSKGSVVGVISIAGYSALPARTGYSSSKYAIRGFLDTLRIEHLKDGLNVLVFAPGYTASNVRNAALTADGSAQGETPLDEGKLMSAEECAELLAKALAKRKSEVILTALGKLTVLAHRLFPRLTDTLTYSYISREKDSPFK

SEQ ID NO: 866 - protein, 256 aa, Artificial Sequence
  Synthetic
MKAKIVFITGASSGIGQGCARKFAKEGWNLILNARTVSKLEELKEELEKAYGVQVCVLPFDVRDRKQAAAALEALPEEWKSIDVLVNNAGLVIGVDKEFEGSLDEWDIMIDTNIRGLLAMTRLVVPGMVERGRGHIINIGSIAGDAAYPGGSVYCATKAAVKALSDGLRIDLVDTPLRVTNIKPGMVETNFTVVRYRGDKQAADNFYKGIRPLTGDDVAETVYYAASAPAHIQIAEVLLMPTYQATGTISYKKKAE

SEQ ID NO: 867 - protein, 248 aa, Artificial Sequence
  Synthetic
MQQLAGKTAIVTGAGRGIGNAIARCFASEGATVILISRSASSCGGAAEEINKEFPGSCTAYPCDVADYDAVRETAAAILANFPQIDILVNNAGITRDTLMLRMKEEDWDSVMATNLKSAFNMVKAFQRVLMKSPAGRIINMSSVVGLTGNMGQANYAASKAGLIGFTKSLAQEFASRKVTSNAIAPGFIATDMTDAIPEKIKEEMLKKIPLGSLGEPNDIASLTAFLASDDARYITGQVITCDGGMTM

SEQ ID NO: 868 - protein, 243 aa, Artificial Sequence
  Synthetic
MNKTAIISGSSRGIGAAIAEELAKKGWNVVINYVRNGQKAEELKDKLSKYSAVIAVQADVSEPSGAEKLFTAAKNRFGKVDLLVNNAGISLIKPLDDVSYDEWKRIFAVNVDGVFNLTKEVLPDMIARKSGKIINVGSMWGQVGASCEVAYSSTKAAVIGFTKALAKEVGPSGISVNCVCPGFIKTDMNACHSAETLSEIKEETPLQALGRPLDVAKAVAFLASDDADFITGQVVGVNGGLVI

SEQ ID NO: 869 - protein, 273 aa, Artificial Sequence
  Synthetic
MHKQIILVTGASSGFGLTTAIMLAAQGHIVYGTSRKATNSVTGSVRMLKMDVTDTLSIAETINRIIQEEGGIDVVVNNAGVGISGALELATQDEIDWQMNTNFKGVVNVCNAVLPFMRKARRGKIINISSIGGLIAIPFQGFYAASKFAVEGYSEALAMEVYPFGIQVCLVEPGDFQTNFTTNRNLSSASLEHEDYGLFFSKTLKVIEDTEKNGASPDKLGRVICKLVKTKHPAFRTKTGLAGQVAFAYCKGILPDKLIQFITRSFYRIAKTR

SEQ ID NO: 870 - protein, 256 aa, Artificial Sequence
  Synthetic
MDKQMLEGKVAIVTGASYGMGSTIAEIFAEEGAAVVLTARHQDKLDAVVSELKEKGYRAIGVMADTGSTEDTVRVFEETIKIFGDVDILVNNAGIGEQTIIDETTDEWMQHIMNVNLGGPMRYIREALKYFLPKDDGVIINISSVNGTRPFCGASYTATKGALNTLTKNVAMRLIETNIRCNAVAPGATVTPAHLANKAGDQPGGAKMLEHSGHFVYFPGPECEPVDQAYACLYLASKMGRHVKGQVLQVCNGAFL

SEQ ID NO: 871 - protein, 248 aa, Artificial Sequence
  Synthetic
MKLLEGKTAIITGAARGIGKAIALKYAQEGANIAFTDLAVDDNAKQTEKEIEALGVKAKAYASNAANFEDTHKVVDEIVKDFGRVDILVNNAGITRDGLMMRMSEQQWDMVINVNLKSAFNFIHALTPVMMKQKSGSIINMSSVVGLSGNAGQTNYSASKAGMIGLAKSIAKELGSRGIRANAICPGFIITEMTGALSDEVKAKWAEQIPLRRGGTPEDVANVAVFLGSDLSSYVSGQAIPVCGGMNM

SEQ ID NO: 872 - protein, 222 aa, Artificial Sequence
  Synthetic
MKRRVFVTGGAHGIGKGIVKAFARQGDEVVFCDLDPVLGAQTETETGTRFCQLDVTDAVSLERCMRELFETWGDIDILVNNVGISPFKPLTELSIEEFDRVIATNLRPVFITSRQLALHRQQNGNHNYGRIINLCSTRYLQSEAGTEAYSASKGGIYSLTHSLAVSLAPLHITVNAIAPGWIHVREEEQLRPEDHAFHPSGRVGTPEDIARACLFLCDEAND

SEQ ID NO: 873 - protein, 273 aa, Artificial Sequence
  Synthetic
MAIKSDSYLASLFGLEGKTIVVTGAGGGIGLAISEGLLRAGAEVALCNRTTAKCKPLADRIIAEGGTASLHKLDVTSLDSIHACVDEVIAQYGKIDVLFNVAGINKREGLLDVEEADYDRIMDTNLKGLFFMSQAVAREMYKRRTGSIINIGSHNDEGMLGGCSVYGATKSGVVALTRAMAIEFAQYGIRANAISPGHILTDLTQVTWDHPTRAPWLRERIAMKRPGSPEELVGMAILLASNASSYMTGQAYHIDGGCLCGGAPWDYDTQYNP

SEQ ID NO: 874 - protein, 256 aa, Artificial Sequence
  Synthetic
MSKRLIDKVALITGAASGQGAAETALFVKEGAKVIATDVNIKLLNQHVDALREQHGDVILPLKLDVTQEKQWVDAIAKGIAKFGKIDVLVNNAGIGVTDKTSGLTDSTIADWRRFMDTNAMAHFLGMKHVVPEMKKNGGGSIINISSLASVQGIAGASPYTASKGASRAFTKGAARDLGKYNIRVNSVLPGWIVTPMMQAFTLNKPLLDSLINGIPLGHLGDPEDVAYPVLFLASDEAKYVNGAELIVDGGQSVRG

SEQ ID NO: 875 - protein, 248 aa, Artificial Sequence
  Synthetic
MGLLTGKTAIVTGAARGIGKAIALKFAAEGANIAFTDLVIDENGENTEKEIAAFGVKVKGYASNAASFEDTARVVEQIKEDFGSIDILVNNAGITKDGLMMRMSEAQWDAVIGVNLKSAFNFIHACTPIMMRQKSGNIINMASVVGVHGNAGQCNYSASKAGMIGLAKSIAQELGSRGIRANAIAPGFIITDMTAKLSDEVKAEWAKKIPLRRGGTPEDVANTALYLASDLSAYVSGQVIQVDGGMNM

SEQ ID NO: 876 - protein, 243 aa, Artificial Sequence
  Synthetic
MPRKTVLVTGASRGIGKAIAVKFAKKGYNVAISCVHREDRLLQTQKEIESFQVPCLAYKGDMGDMKCCEELYGKIKTQFGGVDVLVNNAGISYIGLLQDMTCEDWEKMLCTNLTSVFNCCKLSIPYMLQQKQGKIINISSVWGVVGASCETAYSATKGGINALTKALAKELAPSNIQVNAVACGAIDTEMNQWMEEDDLIALVEEIPSGRLGKAEEVADLVYHLGYKESYLTGQVIGLDGGWI

SEQ ID NO: 877 - protein, 273 aa, Artificial Sequence
  Synthetic
MYISDHVSDYIHISEVTQKHIYIMGLLTGKTALVTGAARGIGKAIALKFAQEGANIAFTDLFIDEEHGGLQTERDIQALGVKAKGYASNAADFAQTADVVAKVKEEFGSVDILVNNAGITKDGLMLRMTEQQWDAVINVNLKSAFNFIHACVPVMMRQRHGSIINMSSVVGVHGNAGQCNYAASKAGLIALAKSIGQEMGAKGIRANAIAPGFIDTAMTQALPDDIRKAWIKNIPLRRAGTVDDIANTALYLASDLSSYISGQVIQVDGGMNM

SEQ ID NO: 878 - protein, 256 aa, Artificial Sequence
  Synthetic
MKALITGASSGIGKEIARYLAELGYDLILVSRSTDKLNKLKEELSNVNVRVITLDFSRESDSLDLYEHIKNENEQIDFLVNNAGFGAYGKFLDVPLERELELIHTNVSTVHILTKLFLKDMAERNSGYILNVGSAAGFLAGPTFASYYASKNYVVRLTQAIHEEMRRDNKNVKVSVLCPGPVKTNFNNVADVKFCIRGLDPKFVARYAVDMTMKGKMIITPGFEMKAVSFFRHFAPEKLLTRISYNVQMKKNGISK

SEQ ID NO: 879 - protein, 248 aa, Artificial Sequence
  Synthetic
MKLLEGKTAIITGAARGIGKEIALRFAKEGANIAFTDLVIDENGKKTEEELVALGVKAKGYASNAADFAQTEEVVKEIHKDFGSIDILVNNAGITKDGLMMRMTEAQWDAVINVNLKSAFNFIHAVLPIMLRQRHGSIINMASVVGVHGNAGQSNYAASKAGLIALAKSIAQEVGSRGIRANAIAPGFIETAMTAALPEEIRKEWELKIPLRRAGQTEDIANVATFLASDMSSYVTGQVIQVDGGMNM

SEQ ID NO: 880 - protein, 243 aa, Artificial Sequence
  Synthetic
MTDKKVALVTGGSRGIGKACAIELAKAGCDVVINYAGNSEAAEKTVEELKALGSNASSYKFDVSNQAEVDEAIAKIIEKYGRIDILLNNAGITRDDLFIRMDADKWNAVINTNLNSAFYVSKPVVKLMMKQRSGAIINTSSVVGLYGNPGQANYSAAKAGLIGFTKSLAKELGSRGIRVNAVCPGFIATDMTKDLPNIDEYLKAIALRRLGEAEDIAKAVKFLALDADYITGQALEVDGGMLI

SEQ ID NO: 881 - protein, 273 aa, Artificial Sequence
  Synthetic
MADNYIERKMEELEARKAMPKKPVSNRAGHKRRVFVTGGASGIGKAIVKAFSNEGYRVAFCDRDAERGKETSKETGALFFPADVSDKEALESCLQQLFDRWGDVDVLINNAGISEFSPLTETTVEEFDRILSINLRPVFVASRYLALHRKQQTFPNPYGRIINLCSTRYLMSEPGTEGYSASKGGIYSLTHALAVSLAEWHITVNSIAPGWIATHDYDRLTRQDHLQHPSGRVGRPEDIARMCVFLCQDGNDFINGENIVIDGGMTKKMIYVE

SEQ ID NO: 882 - protein, 256 aa, Artificial Sequence
  Synthetic
MNLNGKTALVTGSTSGIGLGIARVLAKAGAQLILNGFGDSASAREEIAQLGKKPGYHDADLRDVLQIEAMMRYAESQFGGVDILVNNAGIQHVAPVDAFPVEKWNDIIAINLSAVFHTSRLALPTMRDKNWGRVINIASVHGLVASKEKSAYVAAKHGVVGFTKSLALETARTGITANTICPGWVLTPLVQQQIDKRIADGVPPEQAREQLLAEKQPSGEFVTPEQLGELALFLCSDGAVNVRGAAWNMDGGWVAQ

SEQ ID NO: 883 - protein, 248 aa, Artificial Sequence
  Synthetic
MKLLEGKTAIVTGAARGIGKEIALRFAREGANIAFTDLVIDENGKKTEEEIAALGVKVKGYASNAADFAQTEEVVKQIHQDFGSIDILVNNAGITKDGLMMRMTEAQWDAVIAVNLKSAFNFIHAVLPVMLRQRSGSIINMASVVGVHGNAGQSNYAASKAGLIALAKSVAQEVGSRGIRANAIAPGFIETAMTAALPEDVRAEWCTKIPLRRGGKVEDIANVATFLASDMSGYVTGQVIQVDGGMNM

SEQ ID NO: 884 - protein, 243 aa, Artificial Sequence
  Synthetic
MTDKKVALVTGGSRGIGKACALELAKAGCDVVINFAGNAEAAAKTVEELKALGSNSESYKFDVSNQAEVDENIAKIVEKYGRIDVLINNAGITRDDLFIRMGEDKWNAVINTNLNSAFYVSKPVVKLMMKQRSGAIVNMSSVVGLYGNAGQANYSAAKAGLIGFTKSLAKELGSRGVRVNAVAPGFIATDMTKDLPNIDEYLKAIALRRMGKAEDIAAAVKFLALDTDYITGQVLEVDGGMTI

SEQ ID NO: 885 - protein, 273 aa, Artificial Sequence
  Synthetic
MKTWLITGCSSGIGKGIAKAALKKGYQVVVTARNTEKLKDLYEAYPQTCLPVSLEMTDKQSIQNVIKATYEKFGPIDVLINNAGHGYRAAVEEGDEADIEELYDTNVFGPVTLIKEVLPQMRKQASGTIVNVSSIAAMRSALGSGYYASSKAALELITDALIKEVKPLGIRAMIVEPGSFRTKFYDEALKGTAIKVDDYIKAGVKRREETVNARQQPGDPDKAGEVIVKVIEQEELPHTLLLGSDAVKIVSQELERKLKEIQDYQNISIQTDF

SEQ ID NO: 886 - protein, 256 aa, Artificial Sequence
  Synthetic
MDAKMLEGKTAIITGASYGMGQTMAELFAEEGANVVLTARGQDKLDEAVKRIREKGGNAIGVTADVCSTEDTRKVIDAAIKEFGDLDILINNAGIGEQKMIDETEDDWMRFVMDTNLGGPMRYIREALKIFLPKNEGVIINISSVNGNRPFCGATYTSTKGALNTLTKNVAMRLVDTDIRCNAVAPGATVTPAHLANKEGKQPGGAKMLEYSGHYVYFPGPECDPMDQAYACLYLASKMGRAVRGQVLQVCNGGFL

SEQ ID NO: 887 - protein, 248 aa, Artificial Sequence
  Synthetic
MGLLTGKTAIVTGAARGIGKAIAMKFAAEGANIAFTDLVIDENGQNTEKEIAALGVKVKGYASNAASFEDTAKVVEQIHADFGSVDILVNNAGITKDGLMMRMSEAQWDAVIGVNLKSAFNFIHACTPIMMRQKSGSIINMASVVGVHGNAGQCNYSASKAGMIGLAKSIAQELGSRGIRANAIAPGFIITDMTAKLSDEVKAEWAKKIPLRRGGTPEDVANIALFLASDMSSYVSGQVIQVDGGMNM

SEQ ID NO: 888 - protein, 243 aa, Artificial Sequence
  Synthetic
MLSGKTALITGASRGIGAAIAKKFAEGGANVAIVYQSSDEKAEAVRAEAESLGVTAKIYKCNVAEFDGCKETVAQVIKDFGRVDILVNNAGVTRDNLIALMSDEDFTRVVNTNLGGCFNMIKACSRNFIRNKGGKIINIASVSALIGIAGQSNYAASKAGIIALTKTAAREFASKNVCVNAIAPGFITTDMTESLNADDIVEKIPLKKLGSPEDVANLAAFLADEASDYITGETIRIDGGLAI

SEQ ID NO: 889 - protein, 273 aa, Artificial Sequence
  Synthetic
MAIKSDSYLGALFGLEGKTIVVTGAGGGIGLAISEGLLRAGAEVAMCNRTPAKCQPLADKINAEGGTASVHQLDVTSLDSIHACVDEVMARYGKIDVLFNVAGVNKREGLLDVEEADYDRIMNTNLKGLFFMSQAVAREMYKRRTGSIINIGSHNDEGMLGGCSVYGATKSGVVALTRAMAVEFAQYGIRANAISPGHILTDLTQVTWDHPTRAPWLRERIAMRRPGDPDELVGMAILLASDASSYMTGQAYHIDGGCLCGGAPWDYDTQYKA

SEQ ID NO: 890 - protein, 256 aa, Artificial Sequence
  Synthetic
MNRLEGKVVIITGASGGLGKQMALRFAQEGAKLAICARREKKLQETKDLCQQAGAQVLAMVADVSHHDELKAFVEKTAETFGTIDVLVNNASTISAPHPFLEHTINDLEEALHSGLYGTWQMMQLCFPYMKEHGGSIINFGSIGGVSGLEGFAAYAAEKEAIRGLSRVVAREWGQFGIRVNCVCPNVITDRFEEGIHQSPKEIQEYLIGNMSQNAMHRPGKAYEDFTPAALFLASEDSRWVTGQTLHVEGGAWISA

SEQ ID NO: 891 - protein, 248 aa, Artificial Sequence
  Synthetic
MNKVVLITGGAQGIGKAIALELAKNHYDIVINYLTSHEAAAKLKEEIINTYSVRCLTICADVSNVNQVDQMVSEIEEKLGGVDILVNNAAIDLSNLFHLKTSEEFKRTLDVNVVGAFNCAKRVYRHMLEKEYGRIINISSTNGINTYYPMCIDYDASKAALISLTHNLAFEFAPYVNVNCIAPGFIGTENELDGYDEEFLKEEVEKIMVNRYGDPKEVAYLVKFLISDEADFINNTVIRIDGGQKGSC

SEQ ID NO: 892 - protein, 243 aa, Artificial Sequence
  Synthetic
LNQIKTVIVTGASRGIGKAIALSFAKRHWNVVILASKSASDLEKTKQEIESHGAHCLSLLGDVSDPEFVSFVMEETKKRFSTVHCLVNNAGISYIGLITDMSNEDWNQILNTNLSSVFYFSRAVVPMMLQEQDGCIINISSVWGEVGASCEVAYSATKGGINAFTKALAKELAPSHIKVNAISCGAIHTSMNEWLSKEEEDALIDEIPAGRLGEPEEIAEFAYSLTESSYLTGQIIRMDGGWI

SEQ ID NO: 893 - protein, 273 aa, Artificial Sequence
  Synthetic
MGRNNKKVILLTGATSGFGRTASGMLSAAGHTVYGTGRTVEEGLRGDGVRMLRMDVTDPVSITRAVGRIIAEQGRVDVLINNAGAGIGGAVELATDEERRWQMDTNFMGMTNVCTAVLPHMRRQRSGRIINISSIAGVVAVPYQGFYSASKFAIEGYSEALAVEVRRFGIDVCLVEPGDFRTGFTSSRRMSEATLGDSDYSDSFRRTMAGVEKDETHGSDPAKVGKVLCRLVVSRRPRFRTLTGSFLQTAFARASRILPGRVTQKLLSWFYSV

SEQ ID NO: 894 - protein, 256 aa, Artificial Sequence
  Synthetic
MGKSCVLNTGKMSKETVLITGGSRGIGRAAAELFAARGCNVAVTCIKNSEKAEEFVRCARDKGCCAEYFTCDAGDHDNAARVTSLVMGKFGSIDVLVNNCGISEYALIQDITPDMWKRMIKTNLDSVYNFVNCVAPSMISRKSGAIINVASMWGLTGGAMESHYSAAKAGVVGFTKALAKELCYSGITVNCVAPGPTDTDMMKESFSEEELKLLEKEIPFGRLAAPSEIAEGIYYLAFARTVTGTVLNMSMGMGLD

SEQ ID NO: 895 - protein, 248 aa, Artificial Sequence
  Synthetic
MKLLEGKTALITGASRGIGKAVALAFAKQGANIAFTDLRYDEIAQATEKEIAACGVKAKMYASNAADFAQTATTVEEIAKEFGRIDILVNNAGITKDTLLMRMSEEQWDAVINVNLKSVFNFSKAVSAVMLKQKSGSIISMSSVVGVSGNAGQANYSASKAGIIGFTKSIAKELGSRNIRANAVAPGFIITDMTAQLSEDVRKEWAAKIPLRRGGTPEDIADVCLFLASDLSRYVTGQVIHVCGGMNM

SEQ ID NO: 896 - protein, 243 aa, Artificial Sequence
  Synthetic
MSDTKQVALVTGAAKGIGLAIAKRLSSDGMTVVINSHHPLTDEEKQSFSDAGFSFDNLVGDVANEADAEKMVGEVVEKYGQIDVLVNNAGITKDKLLSRLKLADFKAVIDTNLVGAFNMTKFAMKFMQKSRSGAIVNLSSISGLHGNLGQANYSASKAGLVGLTKTAAREGALRNIRCNAVAPGMVATDMTGKMSERRQKEFTDQIPLKRFAEPDEIADAVAFLIHNQYITGQVVTVDGGLTI

SEQ ID NO: 897 - protein, 272 aa, Artificial Sequence
  Synthetic
MYPDTKIIPFGIINKMFVWRKDKIMGRDLQGRVAIVTGSGRGIGLGIAKKLSEKGASIVISDVNEDNARNGVAEIEAMGGKAIYILADVSKYEDAQNLVDATIKEMGSLDILVNNAGINKDRMLHKMSVDDWNAVIAVNLTGVFNCMRAAVNYMREREYGRIINISSASYLNGNIGQANYAAAKAGVVALTKTCAKENGKKNITCNAIVPGFIDTEMTRGVPEKAWDIMVGKISMGRAGTPEDIGNMIAFLASDEASYITQGVFEVGGGMVL

SEQ ID NO: 898 - protein, 256 aa, Artificial Sequence
  Synthetic
MSNISYIKKGHTDMKVALVTGASRGIGKACAIRLAKDGYAVVINYSHSEEQAQKVLDEIIAAGGTGITYKADVSDLNQVKQMVKDVSKELGGIDVLVNNAGIVRDEYLLMLNKDTLDTCMDLNVKGYFYCAQQAVLKMFRKKSGVIINMSSVSSKFALPGQSVYSATKGAVNSMTQTMAKELAGYGIRVNAVAPGFIETEMLDAIPEEKKKEYLDAIPMHKLGKAEDVANVVSSLCSDAFSYVTGQVIVLDGGLSL

SEQ ID NO: 899 - protein, 248 aa, Artificial Sequence
  Synthetic
MGLLTGKTALITGAARGIGKAIALKFAEEGANIAFTDLVIDENGKATESEIMAKGVKAKGYASNAADFAQTEEVVKQVKEEFGSVDILVNNAGITKDGLMLRMTEAQWDAVIAVNLKSAFNFIHACVPVMMRQRGGSIINMASVVGVHGNAGQANYAASKAGLIALAKSIGQEMGPKGIRANAIAPGFIDTAMTQALPDDIRKEWINKIPLRRGGNVEDIANVATFLASDMSSYISGQVIQVDGGMNM

SEQ ID NO: 900 - protein, 243 aa, Artificial Sequence
  Synthetic
MARTVVISGGSRGIGACIAKAFGALKDNVVINYNKSAKEAENVAREVLNLGGKPLIVKADISKDAEAKYLISEAIKVFGKVDVLVCNAGISGYSLLIDASYDQIREIIDTNLIGTINLCKSASENMIKNQSGAIINISSMWGIIGGAGESVYSASKAGLIGFSKALAKELGLSGITVNVVAPGVINTDMIKNLDEQTLNSLSSQTALNRIGTVDDVAGVVEFLASPKASYITGQVISVDGGIV

SEQ ID NO: 901 - protein, 272 aa, Artificial Sequence
  Synthetic
MKNVLKGKTVVITGASSGIGEAMAKVYAGMGAKLVLGARSEQKLNDLVAQIRADGGEAVCCATDVTKPEDCRRLIEYGVEAFGGIDVLICNAGIAMRAIFDDVDLSVLHRLMDVNFWGTVYCAKYALPYLQKSHGSLVGISSVAGLHGLPGRTGYSASKFAMTGFLETVRIENLKKGLHVMVACPGFTASNVRFSALVADGSQQGSTPRKECNMMTPEQVAKIVAKGIAKRKRLCLMEIEGRATHFVKKFAPAFLDKMFYLVMSREPDSPFK

SEQ ID NO: 902 - protein, 256 aa, Artificial Sequence
  Synthetic
MKNELSVKGAAMEKKVALVTGASRGIGRQISLTLAKEGMFVVVNYCGSEARAKNVLEEIRKNGGDGVLYQCDVADYQQTEAMAKELIKSYGHVDVLVNNAGITRDNLILRMSEEEFDAVVETNLKGCFHTIRHLSRYFLKQKSGKIINIASVSGVLGNAGQANYAASKAGIIGLTKTVARELASRGITVNAVAPGFVHTEMTEVLSSQVKEAAVAQIPLGRFGETQDIANTVAFLASEKADYITGQVICVDGGMAM

SEQ ID NO: 903 - protein, 248 aa, Artificial Sequence
  Synthetic
MQLDGKVALVTGASRGIGRSIALMLAARGADIVINYAGNTEAAEQTKAEVEALGRKALVVKADVGDTAACEKMLEDVVAAMGKIDILVNNAGITRDTLLMRMKEADWDAVLTTNLKSVYNCTKAAIKYMMKARSGRIVNISSVVGAMGNAGQANYAAAKAGILGFTKAVAKETASRGITVNAVAPGFIATDMTAVLSDKVVDNLKAGIPMGRLGAPEDIAKAVAFLVSDDAAYITGQTLHVNGGMYMD

SEQ ID NO: 904 - protein, 243 aa, Artificial Sequence
  Synthetic
MAKKVVLVTGASRGIGKAIAVKFAKKGYNVIINCAHREQELMQTKKEIESYQVTCAAFLGDMGDMAVCEQLFSMIRKQFGSLDVLVNNAGIDYIGLLQDMTSEEWDRILRTNLTSVFNCSKLAIPLMLAAGHGKIINISSVWGCVGASCEVAYSATKGGINAFTQALAKELAPSNIQVNAVACGAIDTEMNQWMEEDELIGLVEEIPSGRLGRAEEVADFVYHLGYKGSYLTGQIIKLDGGWI

SEQ ID NO: 905 - protein, 272 aa, Artificial Sequence
  Synthetic
MTSWLNLEGKTAVVTGGASGIGKTVAQSFLDNGANVVVCDMNPDEPEFELGGSRGKLLYVVTDVTKAESVTAMVEKAKAAFGKLDILVNNAGINIPCLLVDPKDPHGKYELSERVYDKVTSVNIKGVYLMAQALGHEFVRNGAGVIINMSSESGLEGSEGQSIYAATKNAVNSFTRSWSKELGRYNVRVVGVAPGILEATGLRTLAYEEALSYTRGITVEDLRKGYKNTKTTPLGRSGKLTEVANLVLFLASDRASYIHGVTYNVAGGKTRG

SEQ ID NO: 906 - protein, 256 aa, Artificial Sequence
  Synthetic
MEQEMLKGKVAVITGASYGMGQTMAELFAEEGAAVVLTARGQEKLDQVVQGIRAKGGRAVGVTADVCSTEDTKRVFETALREFGDVDILINNAGIGEQKMIDETDDDWMLYVMNTNLGGPMRYIREALKIFLPKNDGVIINISSVNGERPFCGATYTSTKGALNTLTKNVAMRLIDTNIRCNAVAPGATVTPAHLANKAGEQPGGAKMLEYSGHYVYFPGPECDPMDQAYACLFLASKMGRHVKGQVIQVCNGAFL

SEQ ID NO: 907 - protein, 248 aa, Artificial Sequence
  Synthetic
MTGGGYMLLQDKIAVVTGANRGLGKAVALRFAEEGAKVMLVGRNTEALQAVQKMIEAKGGAAEVFCADVTDPAAVDKMAAQIDQSHGRADILVNNAGISIEQPLNDMSIETWKQIIDTNLNSVAVVIKAFLPIMIRRNSGNIVNVGSGAGLRGLPGSCAYSASKAGVICLSQALGDEVRRYGIRVNVICPGPIDTELFQLSERREYLLKNGGDVFSPESVANSILFLASEMSGGMNSQILTMRGINRW

SEQ ID NO: 908 - protein, 243 aa, Artificial Sequence
  Synthetic
MARKTVLITGASRGIGKAIAVKFAKKGYNVVINCAHREQELLQAQKEIENFQVSCTAFLGDMGDLETCERMYKLIRKQYGGLDVLVNNAGISYIGLLQDMSASDWNQIMTTNLTSVFNCCKLAIPFMLEQKQGKIINISSVWGNVGASCEVAYSATKGGINAFTRALAKELAPSNIQVNAVACGAIDTEMNQWMEEDELIGLVEDIPTGRLGRAEEVADLVYHLGYKNTYLTGQVIGLDGGWI

SEQ ID NO: 909 - protein, 272 aa, Artificial Sequence
  Synthetic
MASWLNLEGKTAVVTGGASGIGKTVVQSFLDNGANVVVCDMNPKEPEFERGEGSGDVLYVVTDVTKADSVRAMVEKAKAKFGKLDILVNNAGINIPCLLVDPKDPYGKYELNERVYDKVTNVNIRGVYLMAQALGHEFVKNGKGVIINMSSESGLEGSEGQSIYAATKNAVNSFTRSWSKELGRYNVRVVGVAPGILEATGLRTLAYEEALSYTRGITVEDLRKGYKNTKTTPLGRSGKLTEVANLVLFLASDRASYIHGVTYNVAGGKTRG

SEQ ID NO: 910 - protein, 256 aa, Artificial Sequence
  Synthetic
MKDLFDLKGKVAVVAGASSGLGADAARAYAEYGAQVALLARRKERLDELAEEITAAGGTAFAAACDVTAEESVKNAVEQVLTHYGKIDILLNNAGVAIKGSVEDTSAEDWDKVMDINVKGMYLMCKYVIPGMRSRQYGKIVNVASVNAVMASKTLARHSYNASKAAVRGLTMGMAATYMKDNITINSVGPGLFESEMTANTLFKNEEYLESYRKTNPASRPGRQGELNGTILFLSSDASSYVTSQHILVDGGYTII

SEQ ID NO: 911 - protein, 248 aa, Artificial Sequence
  Synthetic
MGLLSGKTALVTGAARGIGKAIALKFAQEGANIAFTDLVIDENGKATEAEIAALGVKCVGYASNAADFAQTAEVVAKVHEDFGSIDILVNNAGITKDGLMMRMTEQQWDAVINVNLKSAFNFIHACTPIMMRQRSGSIINMASVVGVHGNAGQSNYAASKAGLIALAKSIAQEMGSRGIRANAIAPGFIETAMTAQLSEEVRKEWMKSIPLRRGGQVEDIANVALFLASDMSSYISGQVIQVDGGMNM

SEQ ID NO: 912 - protein, 243 aa, Artificial Sequence
  Synthetic
MQLKNKNIFVTGSSRGIGLAIAHKFAKLGANVVLNSRGAISEELLAEFSNYGVKVVPISGDVSDFADAKRMVNQAIAELGSVDVLVNNAGITQDTLMLKMTEEDFEKVIKINLTGAFNMTQAVLKQMIKAREGAIINMSSVVGLMGNIGQANYAASKAGLIGFTKSVAREVANRNVRVNALAPGMIESDMTAVLSDKVKEATLAQIPMKHFGQAEHIADATVFLAGQDYLTGQVLAVDGGLSM

SEQ ID NO: 913 - protein, 272 aa, Artificial Sequence
  Synthetic
MKKTLKEKVIVITGASSGIGEAMARVYAAQGARVVLGARSVQKLQLIVGEIRAQGGQAVYCGVDVTVPDQCRELIETAVREYGHIDVLICNAGLSMRAIFDDVELSVLHRLMDVNFWGAVNCCKYALPYLQATKGSIVGISSVAGLHGLPGRTGYSASKYAMTGFLETLRIENLKKGLHVMIACPGFTASNVRFSALTANGSQQGETPRDESKMMTAEQVARIVGRGILRRKRLCLMEIEGRATYFVKKFAPAFLDRMFYLVMSREPDSPLK

SEQ ID NO: 914 - protein, 256 aa, Artificial Sequence
  Synthetic
MDKVCVITGGALGIGKELVKKFAEEGYKVIFIDNNKEAISKTEKEFRHDKLNVEGYFGDIAEESVLKEFSSFVINKYEKINVLINNACISRKGIISECSFDDFNYVLKIGVTAPYMLSLLFKNNFAKGGAILNISSTRAFMSQRDTESYTAAKGGIAALTHGLAVSLSGKVRVNSISPGWIDTYESYGMEEPKYSDGDLNQHLSKRVGVPKDIARAALFLCDEKNSFITGENINVDGGMTKLMIYHDDFGWNYDEK

SEQ ID NO: 915 - protein, 248 aa, Artificial Sequence
  Synthetic
MIVLVTGATAGFGECITRRFIENGHKVIATGRRQERLQELKDELGDRLFIAQLDVRNRASIEEMLASLPAEWCDIDVLVNNAGLALGLEPAHKASIEDWENMIDTNNKGLVYMTRAVLPGMVERNRGHIINIGSTAGSWPYAGGNVYGATKAFVRQFSLNLRTDLHGTAIRVTDIEPGLVGGTEFSNVRFKGDDAKAEKAYENTTALTPQDVTEAVWWVASLPAHVNINTLEMMPVTQSFAGLSVHRS

SEQ ID NO: 916 - protein, 243 aa, Artificial Sequence
  Synthetic
MERKTAFISGASRGIGECIAKTLSKEYDVIINYSNSEESANNVLAQLDPSGHHKAIKCNVAKGEEVEAMMKEIIDTYGHIDVIVNNAGITRDNLLLRMSEEDFDSVIDVNLKGCYNCIRYATRQMMKQRSGCIVNMASVVGIMGNAGQANYAASKGGVIALTKSVARELAGRGIRVNAVAPGFIDTAMTQKLDDTVKKQMLSGIPLKRFGDVQDVANVVKFLCSEESAYITGQVINVDGGMVM

SEQ ID NO: 917 - protein, 272 aa, Artificial Sequence
  Synthetic
MSKIIDGRFSDKVMIITGAAGGIGKAVALRAAKEGAKLVLADRKEEMSKETLKEIREITSNVEFLICDLREGENCKKVIDTAIKKFGGLDILINNAGITGTPAPVHEMSEEMFRNVLDCNIMIAFHCSHYGIQEMIKQNKGGAIVNVSSVAGLTGFPGHSAYVTSKHGLNGLTRNMALDYARYGIRVNAVNPGTTDTPMYHEALEFLKNKRESAEKAGVKIEGGIVSGKVTSPQNRVARAEEVADVILFLSSPEASNVTGIFMPVDGGFTAF

SEQ ID NO: 918 - protein, 256 aa, Artificial Sequence
  Synthetic
MEKEMLKGKVAVITGASYGMGQTMAELFAEEGAAVVLTARGQEKLDQVVEGIREKGGRAIGVVADVCSTDDTKRVFKTALREFGDVDILINNAGIGEQKLIDETDDEWMLYVMDTNLGGPMRYIREALKIFLPKNDGVIINISSVNGERPFCGATYTSTKGALNTLTKNVAMRLIDTNIRCNAVAPGATVTPAHVANKAGQQPGGAKMLEHSGHFVYFPGPECDPMDQAYACLFLASKMGRHVKGQVIQVCNGAFL

SEQ ID NO: 919 - protein, 248 aa, Artificial Sequence
  Synthetic
MGLLTGKTAIVTGAARGIGKAIAMKFASEGANIAFTDLVIDENGKNTEAEIAALGVKVKGYASNAASFEDTAKVVEQIKEDFGTIDILVNNAGITKDGLMMRMSEGQWDAVINVNLKSAFNFIHACTPIMMRQKSGNIINMASVVGVHGNAGQCNYSASKAGLIGLAKSIAQELGSRGIRANAIAPGFIITDMTAKLSDEVKAEWAKKIPLRRGGTPEDVANIALFLASDLSAYVSGQVIQVDGGMNM

SEQ ID NO: 920 - protein, 243 aa, Artificial Sequence
  Synthetic
MSEKKVALITGGSRGIGLACALELAKAGCDIIINDICDAEKAQPAIDEIKNLGVNAYFYQFDVSNDEQVQAAVDKMISEHGKIDILLNNAGITKDGLFIRMDMEQWERVIKINLTSAYCVTHAVVKYMMKARQGSIINMSSIVGRHGNAGQANYSASKAGLIGLTQTLAKELGSRNIRVNAVCPGFIQTAMTAELANLDEYLKAIPMKRLGTPEDIAKVVKFLALDTDYVTGQAIEVAGGLMI

SEQ ID NO: 921 - protein, 272 aa, Artificial Sequence
  Synthetic
LPALTELRLMKTAVVTGGSSGIGLSCCRKFLENGYRVYELSRREPKIQTVGVKHISCDVTDERSVSEAFKKIYNDSGSIDILVNNAGFGISGAVEFTELAEAKKQFDVNFFGCFICSKNVIKYMRLQGGGRIVNLSSLAAPLAIPFQAFYSASKAAVNSLTLALANEVRPFNIKVCAVMPGDVKTGFTAAREKNTAGDEFYGETLKRAVAGMERDEQNGMSPDDIADAVYAAATKARPKLLSTKGAKYHLFLALSKALPVSLVNIIVGKLYS

SEQ ID NO: 922 - protein, 256 aa, Artificial Sequence
  Synthetic
MEAKMLEGKVAVITGASYGMGQTMAELFAEEGASVVLTARGKEKLNQVVEGICKKGGKAIGIVADICSTADTKKVMEKTIETFGDLDILINNAGIGEQKMIDETEDEWMMQVMNTNLGGPMRYIREALKIFIPKNEGVIINISSVNGNRPFCGATYTSTKGALNTLTKNVAMRLIDTNIRCNAVAPGATITPAHLANKAGEQPGGNEMLKYSSHYVYFPGPECEAMDQAYACLYLASKMGRAVRGQVLQVCNGAFL

SEQ ID NO: 923 - protein, 248 aa, Artificial Sequence
  Synthetic
MKLLEGKVAVVTGAARGIGKAIALQFAKEGANIAFTDLVIDENGKATEAEIAALGVKAKGYASNAANFEETHKVIDEIVKEFGRIDILVNNAGITKDGLMMRMSEAQWDAVLTVNLKSAFNFIHAVVPVMARQKSGSIINMSSVVGVSGNAGQCNYSASKAGMIGLAKSIAKEMGPRGIRANCIAPGFIITDMTNQLSDEVKENWCKQIPLRRGGTPEDVAKVALFLASDLSSYVSGQVIHCCGAMNC

SEQ ID NO: 924 - protein, 243 aa, Artificial Sequence
  Synthetic
MPKTALITGASRGIGRAIAIEFAKAGYQLVITCSKSEAALLDLKDFLEREYHTQILTSVGDVSSYSYIEQLFSEVAARFGGIDVLINNAGISYIGLLTDMSIEDWNHIVETNLTSVFSTCRLAIPHMVHCKQGKIINISSVWGIAGASCEVAYSACKGGINAFTKALAKELAPSNIQVNAIACGVIDTSMNACFSEEERMVLAEEIPAGRFGRPEEVASLALQLATENQYLTGQIITLDGGWL

SEQ ID NO: 925 - protein, 272 aa, Artificial Sequence
  Synthetic
MGDRIWQIRPAERRNIMDAKMLDGKTAIITGSSYGMGRSMAELFAEEGTNVVLTARGKEKLDEVVDEIRGKGGKAIGVVADVCSTEDTKRVMEETLKAFGDLDILINNAGIGEQKMIDETDDDWMRYVMDTNLGGPMRYIREALKIFLPKNDGVIINISSVNGTRPFCGATYTSTKGALNTLTKNVAMRLVDTNIRCNAVAPGATVTPAHLANKAGEQPGGAKMLQYSGHYVYFPGPECDPMDQAYACLYLASKMGKAVRGQVLQVCNGAFL

SEQ ID NO: 926 - protein, 256 aa, Artificial Sequence
  Synthetic
MDAKMLDGKVAIITGASYGMGQTMAELFAEEGASVVLTARGRGKLDQVVEGICAKGGRAIGITADVCSGEDTKKVIQETIKTFGDLDILINNAGIGEQKMIDETDDEWMMHVMDTNLGGPMRYIREALKIFLPKNEGVIINISSVNGNRPFCGATYTSTKGALNTLTKNVAMRLVDTNIRCNAVAPGATVTPAHLANKAGEQPGGNKMLAYSGHYVYFPGPECDALDQAYACLYLASKMGKAVRGQVLQVCNGAFL

SEQ ID NO: 927 - protein, 248 aa, Artificial Sequence
  Synthetic
MKLLDGKVAVVTGAARGIGKAIALEFAKEGANVAFTDLAIDENGKATEAEIAALGVKAKGYASNAANFEETHAVIDQIIKDFGRIDILVNNAGITKDGLMMRMSEAQWDAVLTVNLKSAFNFIHAVVPVMARQKSGSIINMSSVVGVSGNAGQCNYSASKAGMIGLAKSIAKEMGPRGIRANCIAPGFILTDMTAQLPDEVKEGWYKQIPLRRGGTPEDVARVALFLASDLSSYVSGQVIHCCGAMNC

SEQ ID NO: 928 - protein, 243 aa, Artificial Sequence
  Synthetic
MKTVLITGGSRGIGKAVAIKFAEKGNQIIINYVSEKTDTEKLKNELLEAGAKDVLLIKADVSNSEDVKNMVKESIEKFEKIDILVNNAGITKDNLLMRMSEEEFDKVIQINLKGTYLVTKEVTKYMMKKRSGSIVNLASVVGVAGNAGQCNYAASKAGIIGFTKSIAKELASRNIRANAVAPGFIETDMTNVLKEEIKENINSQIPLRRMGSAKEVAELVYFLGEDASSYITGQVINVDGGMI

SEQ ID NO: 929 - protein, 272 aa, Artificial Sequence
  Synthetic
MDKIIIEPITSMKNAFSVAGQNVVITGGNRGLGRGIAQAFAECGANVAILCRNEASGNEAAEQLRLLGSRAIAVKCDVGDFDSVLRAKEVVASEFDHIDTLVNNAGIDGKHGVFDDARLEEFKRVMNVNLDGVAAMIQVFGQWMMDEGRGGEIINISSIGGQAIGDPRSHPMPSYNASKAALDHLTRHLAIVMGDYGIRVNSIAPGPTHSDLDAGLPPSITEFIDVTMPMHRFGEPLEIGALAVFLSSPAAAQITGVVANHDGGTMCVGLTF

SEQ ID NO: 930 - protein, 256 aa, Artificial Sequence
  Synthetic
VLIEILEGRIEESMQDKVVIVTGGSRGIGASIVKTLARKGYNIILNYNKSEKIAEQIKKELEEEKITIYTYKADVSNREEARGLIEFAIEKFKKIDVLINNAGISQMKLFTDITDTEWNDMLNINLNSAFYCTQEATKHMLINKEGCIINISSIWGITGASCEVHYSTAKAALNGFTKALAKELGPSNIRVNAIAPGMIDTDMNKDIPEQDKQDFIQEIPLEKIGKTEDISKCIEWLIEDNYTTGQIISINGGIVI

SEQ ID NO: 931 - protein, 248 aa, Artificial Sequence
  Synthetic
MFELTNKNAIVTGASRGIGKAVALKLAALGANVAVVYAGNAEKANETVAEIESLGVKAKAYCCDISSFDSAKELIASVIEEFGGVDILVNNAGIVKDCLVLSMKEEDFDRVIDVNLKGTFNMIKNVYQHMMKKRRGRIINLSSVVGLNGNAGQANYAAAKAGIIGMTKSVAKELAARGVTVNAIAPGFIGTDMTAALSDKNKEAIMASIPAKKMGTPDDIANTVAFLASDEASYITGEVIKVDGGMAM

SEQ ID NO: 932 - protein, 243 aa, Artificial Sequence
  Synthetic
MKGYEIMNSVHTVLITGASSGIGKAMVKYLSASGYRVVLVARHLGKLQEVVGEISGESLCIPYDLQDLCNIETIFKKCSENGIKLYGMVHCAGINRDQPVKTNNLNDMIEVMNLNLMSFIELAKYFYKRKYSEDGGAIVAMSSMAAFDCAKGMCTYSASKAGVDAAVQVMSKEFAKRKIRVNSIQPSFVNTPMARMTVNYEAKFNAQPLGVIEPQYIAYLAGFLLSDEAKYISGSNIKVSAGV

SEQ ID NO: 933 - protein, 272 aa, Artificial Sequence
  Synthetic
MKTRMNGKTVLITGASSGIGRAAALAFARQGASLALVARNAERLQAVAEEVRALGVAAEPYLADTSDQAQIESAVQSALARFGSLDAVLCNAGIYLRCPAKDLSMVQIRAIMETNFFGTLNTVYAVLPHLLAQRAGSIVITSSMDGKKGVPPDAAYAATKFALNGFQQVLRQELRGSGVHVGAIFPSRTDTPQIAHVDCPGITPKADPSLVANAMVKCVLKRKKEMLVPFGPCKLLVLADALSPSLGDWMVRAFKLDGIQAREPVVLEETLK

SEQ ID NO: 934 - protein, 256 aa, Artificial Sequence
  Synthetic
MLALITGSSSGIGRDMSRELASLGYDLVLVARNKEGLNKVKLELNQEYPKIKIEYYALDLSIKENCYKLYQNVPKVDILINNAGFGLFGKFCQTNIETEINMINTNITAVHILTKLYLKEMIKIDKGHILNVASIAGFMPGPLMATYYASKNYVVSLTRAINKEIKKSKSNVKLSLLCPGPVDTNFNNVADVKFNIPGLTSQYVAKYAIRKMKKGKLIIVPGTLVKIARILSEITPTAIVEEISYHMQTKKEKQGK

SEQ ID NO: 935 - protein, 248 aa, Artificial Sequence
  Synthetic
MKLLEGKTAVITGAARGIGKAIALKFAQEGANIAFTDLVIDENGKKTEEEIKAYGVECKAYASNAANFADTEKVVNQIKDDFGRIDILVNNAGITKDGLMMRMSEAQWDAVIAVNLKSAFNFIHAVLPIMMRQRSGSIINMASVVGVHGNAGQANYAASKAGLIALAKSIAQEVGSRGIRANAIAPGFIETAMTAALPDSVREEWCKKIPLRRGGKPEDIADVATFLASDLSSYVSGQVIQVDGGMNM

SEQ ID NO: 936 - protein, 225 aa, Artificial Sequence
  Synthetic
MAKKVVLVTGASRGIGKAIAVKFAKKGYNVIINCAHREQELMQTKKEIESYQVTCAAFLGDMGDMAVCEQLFSMIRKQFGSLDVLVNNAGIDYIGLLQDMSPEDWDRILRTNLTSVFNCCKLAIPLMLPAGHGKIVNISSVWGCVGASCEVAYSATKGGINAFTKALAKELAPSNIQVNAVACGAIDTEMNQWLEEDELIQLVEEIPAGRLGRAEEVADFVYHLG

SEQ ID NO: 937 - protein, 272 aa, Artificial Sequence
  Synthetic
MNEMFSIAGKVAVITGAGGVLGGNVARSFVQQGANVVALDIRQEQLDKRVGELRSLKGGEVIGLICNVLDVDSIRKVADKVVAKWGRIDILINIAGGNMPGATLRPDQPIFEMKIEDWNKVTNLNMNGTVYPSMVISEVMARQKSGSIVNISSMAALQALTNVPGYSAAKAAVTNFTRWFATDMALKYGDGIRVNAVAPGFFIGEQNRAVLLNPDGSLTERSHKVLTNTPMRRFGDITEINGAILFLCSDAASFITGVNLPIDGGFSMFSGV

SEQ ID NO: 938 - protein, 256 aa, Artificial Sequence
  Synthetic
MRGKIVFITGASSGIGEGCARKFASQGSDLILNARNVAKLEELKKELEATYGVRVFLLPFDVRDRKAATQALASLPETWKAIDVLVNNAGLVIGVDKEFEGNLDEWDIVIDTNIKSLLAITRLVVPGMVERGRGHIINIGSIAGDAAYPGGSVYCATKAAVKALSDGLRIDLVDTPLRVTNVKPGMVETNFSVVRYRGDKQAADNFYKGIRPLTGDDIAETVYFAASAPEHIQIAEILVMPTYQATGTISYKRKAE

SEQ ID NO: 939 - protein, 248 aa, Artificial Sequence
  Synthetic
MLLENKVAIVTGGTRGIGYATVKEFLKQGAKVALFGSREETVRVALEKLREENPDYPVIGLYPNLMDANEVKEAFQKVVHEFGHLDVLVNNAGISQRDKIFDYNIEDFEKIMNLNVNAVFVCSKEAAHIMKEQGGGVILNTSSMVSLYGQPAGAGYPTSKFAVNGMTKSLARGLGKDHIRVNAVAPGVIKTDMVAALPDEVIQPIINTIPLRRVGEPEDVANAFVFLASEMASYITGVVLSVDGATMS

SEQ ID NO: 940 - protein, 242 aa, Artificial Sequence
  Synthetic
MKTALITGASRGIGEATAYQLAKEYDCVAIMSRNTDGKLNTVANQIHATTNCECIPFTGDVSDFAFVEECVRSLAASGHPVDTLVNNAGISLVGLFQDMTPDEFDRILRINVTSVYNTCHAVIPDMVRNQRGRILNISSVWGLVGASCEVAYSATKGAINSLTMALAKELAPSHIAVNAIAFGAVDTTMNGHLSVEEKKALCEEIPAEKMAAPEEAAACISHILAMPDYMTGEILKFDGGWI

SEQ ID NO: 941 - protein, 272 aa, Artificial Sequence
  Synthetic
MMIQDKFISLEGKVAIITGAGQGIGLAIAQLYAKYGAAVAMVDVSDKCAEEAGKIRELGAEAQAFKCDVTSEDDVKKTVEAVMQAFGHIDILVNNAGIIVRKTVLDTTVEEWDRCMDIGLKGTFLFSKHVVPIMIKEGDGVIVNTASGAALKGVPDAAPYNAVKGGVAALTRGMAVDFGKYNIRVNCVCPGDILTPMLISEGLQTGKITTGDPKTPEEQAAFDAFIASCGDYRPLQRIGTAEQIAYTFLFLASDMSYYATGGSFVVDGGRCS

SEQ ID NO: 942 - protein, 256 aa, Artificial Sequence
  Synthetic
MDAQMLEGKVALITGASYGMGRTIAELFAEEGACVVLTARHVEQLNEVVEGIRVKGGKAVGVVADVCSTEDTKRVFKTAIETYGDLDILINNAGIGEQKIIDDTSDEWMLHVMNTNLGGPMRYIREALKVFLPKNDGCIINISSVNGNRPFCGATYTSTKGALNTLTKNVAMRLIDTNIRCNAVAPGATVTPAHLANKAGEQPGGSKMLNWSGHFVYFPGPECDPIDQAYACLYLASKMGRHVKGQVLQVCNGAFL

SEQ ID NO: 943 - protein, 248 aa, Artificial Sequence
  Synthetic
MKLLEGKVALITGAARGIGKSIALKFASEGADIAFTDLRRDENMEATEKEIEALGVKAKGYSSDASNFAQTEEVVAKVKEDFGHIDILVNNAGITKDGLMMRMSEAQWDMVINVNLKSAFNFIHAVLPIMMRQRSGSIINMASVVGVHGNAGQANYAASKAGLIALAKSIAQEVGSRGIRANAIAPGFIETAMTAALPEDVRKEWAAKIPLRRAGQVEDIANVATFLASDMSSYVSGQVIEVDGGMNM

SEQ ID NO: 944 - protein, 242 aa, Artificial Sequence
  Synthetic
MNKIIIVTGASKGIGKEIAKKLAKKGNTIIANYNKSEKEIKELQKELEKQNIKIDIFQADISKREEAKKIVNYTIQKYGKIDVLINNAGISQIKEFTQITDQEWNNMINTNLNSVFYMTQEACLNMIHNKQGCIINISSIWGITGASCEVHYSVSKAGVDALTKSLAKELGPSNIRINSIAPGIINTEMNSHLTPEELEELKEEIPLEKIGKTQDIERCVEWLIEDEYTTGQIISINGGWNI

SEQ ID NO: 945 - protein, 272 aa, Artificial Sequence
  Synthetic
MGAFSAPFDTPASEERGTIMKQLNEKVAVVTGAGQGIGKGIALCLAKRGVKVIATGRRLEPIEATIAEIHELGGEGFAMTCDSADRERVFEVVAKAVETYGSIDVIVNNGQAIVPSQPVEDTEYDNMLKAWESGVIGSLNYMQAAFPHMKEQHEGRIINFASATGMFGIAGQLAYGSNKEALRGLTKIAAKEWGQYGITVNVVLPGAESPAAKAWAEKFPEEYAKQVNLNPMKRFGDPEMDIAPVIAFLAGPDSCYFSGQSVIVDGANSIMP

SEQ ID NO: 946 - protein, 256 aa, Artificial Sequence
  Synthetic
MNLQGKTALVTGSTSGIGLGIAQTLANAGAQVILNGFGDVDAAINAVSRMGKTPGYHEADLSDESQIINMMAYARREFGGVDILVNNAGIQYVSPVESFPVEKWNAIIAINLSSVFHTTRLALPEMRTRNWGRIINIASVHGLVASKDKSAYVAAKHGVVGLTKTIALETAQTGITCNALCPGWVLTPLVQQQIDKRIAQGEDAESARDALLSEKQPSREFVTPQQLGELALFLCSDAAAQVRGVAWNMDGGWVAQ

SEQ ID NO: 947 - protein, 248 aa, Artificial Sequence
  Synthetic
MKLLEGKTALITGAARGIGKAIALKFAAEGANIAFTDLVIDENGKQTEAEIEALGVKAKGYASNAADFNQTKEVVDQVKADFGTIDILVNNAGITKDGLMMRMTEAQWDAVINVNLKSAFNFINAVLPIMLRQRSGSIINMASVVGVHGNAGQSNYAASKAGLIALAKSIAQEVGSRNIRANAIAPGFIETAMTAALPDDVRKEWVSKIPLRRGGQVEDIANVATFLASDMSSYVSGQVIQVDGGMNM

SEQ ID NO: 948 - protein, 242 aa, Artificial Sequence
  Synthetic
MEKIAIVTGASRGIGKEIAIQLAKNGVKVIANYNKSENQAKELKQELEKINIKIDIFKADVSKREEGHKLVEYALNKYGKIDILINNAGISEYKMFTDETDDDWNRVINNNLYSAFMMSQEVIPSMVHEKSGCIINISSIWAMVGASLEVIYSVSKAGMDGLTKALAKELGPSNIRVNSIAPGTINTEMNKNFSKEELEQIEENTPLGRIGSPKDIAKCVCWLIDDNFTTGQIISINGGWVI

SEQ ID NO: 949 - protein, 272 aa, Artificial Sequence
  Synthetic
MKNALKDKTVVITGASSGIGEAMAKVYASMGAKVVLGARHADKLEALCRSIEQQGGRAAWCATDVTRPEDCKRLIDTAVENFGGIDVMICNAGISMRALFDDVDLDVLHRLMDVNFWGTVYCTKYALPYLQKSHGSLVGISSVAGIHGLPGRTGYSASKFAMTGFLETIRIENLKKGVHVMVACPGFTASNVRFSALTANGSQQGATPRKEEKMMTAEQVARIVAHGIARRKRLCLMEIEGRATHFVKKFAPGLVDRLFYYVMSKEPDSPFK

SEQ ID NO: 950 - protein, 256 aa, Artificial Sequence
  Synthetic
MEQQMLKDKVAIITGASYGMGRTMAELFADEGAAVVITARHAQQLNEVVDGIRAKGGKAVGVVADVCSTEDTKKVFETALREFGDVDILINNAGIGEQKMIDETDDDWMMYVMNTNLGGPMRYIREALKIFLPKNDGVIINISSVNGARPFCGATYTSTKGGLNTLTKNVAMRLIDTNIRCNAVAPGATVTPAHLANKAGEQPGGAEMLKYSGHFVYFPGPECDPMDQAYACLYLASKMGKAVRGQVIQVCNGAFL

SEQ ID NO: 951 - protein, 248 aa, Artificial Sequence
  Synthetic
MNKVVLVTGGAKGIGKAIVEELGKQGYDVVINYLTSKKEALVLKDRLIETYGIRCMAIQADVSKEEEVDAMVISIEKELGGVDILVNNAAIDLSNLFHLKTAEEFRRTMDVNVVGAFNCSKRVYRHMLTQEYGRIINISSTNGINTYYPMCIDYDASKAALISMTHNLAFEYAPYVHVNCIAPGFIGTENELDGYDEEFLKEEIEKIMVNRYGDPKEVAYLVKFLISEEADFINNTVIRIDGGQKGSC

SEQ ID NO: 952 - protein, 242 aa, Artificial Sequence
  Synthetic
MKKTIVITGASRGIGRAIAIELAGKDTNIVINCVNNVDKLNEVKSIIEEKGSECETFAGNMGNYSDVQKMFDMCLQRFGQIDVLINNAGISVVGLFQDMSEDEWHRICNTNIDSVFNCCHFAVKDMMKRHCGKIINISSVWGLYGASCEVAYSATKGAVNSFTRALAKELAPSGIQVNAVACGAIDTEMNGHLSDDDKAELAEEIPAGRFGAPQEVAELVKSLSGINNYLTGQIITLDGGWI

SEQ ID NO: 953 - protein, 272 aa, Artificial Sequence
  Synthetic
MNYTLDSLFGVQGDVIVVCGGTRGIGREIANALADLGARLAIVATRQEACEQAAEELKARGAADAIGCAADVTDFAAVQGAFARIYEKYQRIDGLVNCAGINHVAPLLEIDMENFNHVVDVNFTGIVHCCKAAGQYMLPAHKGRIVNVSSLSALQGKAKYTAYSASKAAINGFTRALSTEWCAQGVNVNVLSPGLVVTDINRATIMANPDGYRRRIEAIPRGVPGRLEWLVSPVVMLLSPGSAHLTGQVICVDGGISTGDTFVMDRKPQDPA

SEQ ID NO: 954 - protein, 256 aa, Artificial Sequence
  Synthetic
MNFSLDFFSLQGKVAMITGGNTGIGREIALALAAAGADIFIYAHSNRDMDSLIEEVAKFGKEARFSTGDLSKEENAMSAVSECIKAYGKIDILVNNAGTIKRSPLLEGSNDDWKTVLDINLSAVYYLSKTAAVEMAKQGHGKIINIASMLSFQGGKFVPSYTASKHGVVGLTKAFANELAGKNIQINAVAPGYIKTANTAPIRADEVREKEILNRIPAERWGETSDLVGGVVFLASKASDYVNGHILAIDGGWLVR

SEQ ID NO: 955 - protein, 248 aa, Artificial Sequence
  Synthetic
MKKIAMVTGATSGIGRACAEHLVKAGYRIIVTGRNAAVLAELRSAHGDDVYSLEFDVRDRKACEEAVASLPAEWSEIDVLVNNAGLALGLEPEYEGDYSDWDTMIDTNIKGLLTMTRTIVPGMVARNRGHIVNIGSVAGDAAYANGSVYCATKAAVKSITDGLRIDVAHTALRVTLVKPGLVETNFSNVRFHGDKERAGSVYNGITPLTGDDIADAVVYAVQAPAHVQLAEMLILATHQASGSVVVRK

SEQ ID NO: 956 - protein, 242 aa, Artificial Sequence
  Synthetic
MLRTILITGASSGIGAATAIAFANPNNRLILVSRKNREGLKKIEDEGRERGAEVLSILADVSDYESCKSLLTEANEHFGPIDLLINNAGISHIGLFQDMTPDEWQRVMNVNIGSVMNLCHLVIPSMVHRHHGRIINISSVWGNVGASCEAVYSASKGAINSFTKALAKELAPSNIQVNAIAFGAIETPMNAWLSKEEADALADEIPSGREGTKEEAAQMICMVADAPDYLTGQILTMDGGWI

SEQ ID NO: 957 - protein, 272 aa, Artificial Sequence
  Synthetic
MEQKAIREFLERTFSLEGRTAVVTGAAGGIGSKIAEALACAGADIALCDINMENLGKTGETIREKGGNAKPFVVDVTDTDSVSSGVREIIKEYGHIDILVNCAGINRREGLMDVSEETYDRIMDINLKGVFRVSRAVAPYMKEQNKGSIINIGSHNTGSILGGCSVYGATKCGVLSMTRSMAVEWAKYNIRANCVSPGHIRTELTVPTWQSPEKSKYLLDRIALARPGHPEDIAGVCVFLASDASGYITGDEIRIDGGCICGGQPWPYETKF

SEQ ID NO: 958 - protein, 256 aa, Artificial Sequence
  Synthetic
MEKEMLKGKVAIITGASYGMGQTMAELFAEEGAAVVLTARGQEKLDRVVEGIRAKGGRAVGVVADVCSTEDTRRVFETAVRELGDVDILINNAGIGEQKMIDETDDDWMLHVMNTNLGGPMRYIREALKIFMPKNDGVIINISSVNGERPFCGATYTSTKGALNTLTKNVAMRLIDTNIRCNAVAPGATVTPAHIANKAGEQPGGAKMLEHSGHFVYFPGPECDPMDQAYACLFLASKMERHVKGQVIQVCNDAFL

SEQ ID NO: 959 - protein, 248 aa, Artificial Sequence
  Synthetic
MNKVVLITGGACGIGRAIALELAKNKYNIVINYLTSQKAALSLEEEIVQTYGVRCMSIRADVSDVEQVDQMVTKIEKELGGVDILINNAAIDLSNLFHLKNAEEFRRTLDVNVVGAFNCSKRVYRHMLDQEYGRIINIASTNGINTYYPMCIDYDASKAALISVTHNLAFEFAPYIHVNCIAPGFIGTENELDGYDEEFLKEEVEKIMVKRYGDPKEVAYLVKFLISEEADYINNTVIRIDGGQVGSC

SEQ ID NO: 960 - protein, 242 aa, Artificial Sequence
  Synthetic
LKTAIIIGASTGIGRATALALSGKYNSISITSFKHKEELLSLRDELMAKGCICYCETGDAGDMEFMEKFIQNTIDHLGSDIDLLINNAGISYVGLINDMTAQDFDRTMKSNVYSVFNSCRLVVPHMIQHHKGHIINISSVWGNVGASCEVAYSASKGAVNSFSKALGKELAPSGITVNAIAFGAIDTSMNGHLSPEERQMLEDEIPAGRMAKPSEAADFIVHIAECGEYLNGQVITFDGAWQ

SEQ ID NO: 961 - protein, 272 aa, Artificial Sequence
  Synthetic
MSYKMYSYIKIFTGGTMNNNIFGLKGKTAVITGAGNGIGKAAALILAENGVNVVCGDLHKETAEKTAEEAKKFGVKAVGVSCDVTVEKDLENLAAEAVKAMGGINILVNNAGGGGGGREKFDTLTLDYIEKIYKLNVFSIYKLSQLCAPYMNKDEYGSIINISSMAGQMTSHNMSVYGSSKAAVNQLTKYMAVDLGPHIRVNAIAPGAIKTDALKSVLTEDMEKKMLVNTPLKVLGETKDIANMILYFASPLSKWVSGQIIAVNGGGVQSLD

SEQ ID NO: 962 - protein, 256 aa, Artificial Sequence
  Synthetic
MTLKGKTALVTGSTSGIGLGIALSLAEAGADLLLNGFGEVDAALAQVRARGVRAEHHPADLSSPEQIGELMAFAERTFGGVDILVNNAGIQYVAPVQEFPTERWDAIIAINLSSVFHTTRLALPGMLARGWGRIVNIASTHGLVASAGKSAYVAAKHGVLGLTKSVALETARTPVTCNAICPGWVLTPLVQKQIDARIAEGVSPEQAEHDLLAEKQPSLAFVTPEQLGGLTLFLCSEAADQVRGAAWNMDGGWVAQ

SEQ ID NO: 963 - protein, 248 aa, Artificial Sequence
  Synthetic
MGLLTGKTAIITGAARGIGKAIALKFASEGANIAFTDLVIDENGKKTEAEIAALGVKAKGYASNAANFEDTAKVVEQIHADFGSIDILVNNAGITKDGLMMRMSEGQWDAVINVNLKSAFNFIHACTPIMMRQRSGNIINMASVVGVHGNAGQCNYSASKAGLIGLAKSIAQELGSRGIRANAIAPGFIITDMTAQLSDEVKAEWNKRIPLRRGGTPEDVANIALFLASDMSSYVSGQVIQVDGGMNM

SEQ ID NO: 964 - protein, 242 aa, Artificial Sequence
  Synthetic
MKKTIVITGASRGIGRAIAIELAGKDTNIVINCVNNVDKLNEVKSIIEEKGSVCETFIGDMGNYSDVQKMFDMCLQRFGQVDVLINNAGISVVGLFQDMSEDEWHRICNTNIDSVFNCCHFAVKDMMKRHCGKIINISSVWGLYGASCEVAYSATKGAVNSFTRALAKELAPSGIQVNAVACGAIDTEMNSHLSDDDKAELAEEIPAGRFGDPQEVAELVKSLSGMNSYLTGQIITLDGGWI

SEQ ID NO: 965 - protein, 272 aa, Artificial Sequence
  Synthetic
MDWIYGKTVLITGASSGLGRAMTVRLIKEHNCKVIGIGQSEPKMKSLIDELSYQKDAFTYQLFDVGVKKNWEIFSEKILANNINIDILINNAGILLPFDKSYNYSEEAVEKCMNTNFNSCRYAINSMLPVLRKSTMPGILNISSSDALAPIIGTGIYSASKAALKAYSEVLIAELGREMYIGYACPGFMKTDIFRHQYVISQSSLINMFSANVDKVAGKIIKKIIRQKSRIIVGKDAKFMNFTSKFFPVLGLKFYEQVIKSSKVKMFDNVRY

SEQ ID NO: 966 - protein, 256 aa, Artificial Sequence
  Synthetic
MEQQMLKDKVAIITGASYGMGRTMAELFADEGAAVVITARHAEQLNEVVDGIRAKGEKAVGVVADVCFTEDTKKVFETAMKEFGDVDILINNAGIGEQKMIDETDDEWMMYVMNTNLGGPMRYIREALKIFIPKNDGVIINISSVNGTRPFCGATYTSTKGALNTLTKNVAMRLIDTNIRCNAVAPGATVTPAHLANKAGEQPGGAEMLKYSGHFVYFPGPECDPMDQAYACLYLASKMGRAVRGQVIQVCNGAFL

SEQ ID NO: 967 - protein, 248 aa, Artificial Sequence
  Synthetic
MQLDGKVALVTGASRGIGKSIALLLASCGADIVINYAGNTEAAEKTKAEVEALGRKAIVIKTDVADTEACEAMLAEVVEKMGRIDILVNNAGITRDGLLMRMKEADWDAVLSTNLKSVFNCTKAALKYMMKARSGRIVSISSVVGAMGNAGQANYAAAKAGILGFTKATAKEVAARGITVNAVAPGFIATDMTAVLSEKIVENLKANIPMGRLGDPADIAKAVAFLVSDDAAYITGQTLHVNGGMFMD

SEQ ID NO: 968 - protein, 242 aa, Artificial Sequence
  Synthetic
MLRGKTAVITGASRGLGEAIAYKFASMGADIAVIDIGNAALAEGVADKCRTEYNVRAKSYMCDVSDFEAVKKTVSCIKEDFSTVHILVNNAGITRDGLAAVMKEEDFDQVIAVNLKGAFNMLRHTVGLFIRNRGGCIINIASVAGIMGNAGQCNYAASKAGIIGLTKTIARELAPKGIRCNAIAPGFIATDMTRLQTDNPMVKTIPLGRMGKAEDVAQAAGYLAVAEYVTGEVLRVDGGIAM

SEQ ID NO: 969 - protein, 271 aa, Artificial Sequence
  Synthetic
MSKYKLNGLTAVVTGASSGIGRAVAEKLIARYGCTVVGVGRDENKFRDFSEKLGENVSRFSYRLFDVGNREEWKEFCTFLTKSGIRPDLLVNCAGILPSFSFYGENSDAELAVKTNFLSVVYSFETLGPLLKESVRPKIVNVGSSSSLCPFAGVAAYCASKAAIERFTECVALEKGIPAAIVMPGFTDTDVFRFQNFDAKSKTFFQKFSMTVDRMSDKIIKTIGKGTRRKIIGLDAHLMNFGYKFFPHLTPVLITKILKSVKSDAFQNITR

SEQ ID NO: 970 - protein, 256 aa, Artificial Sequence
  Synthetic
MESQMLAGKVAVITGASYGMGETMAELFAEEGAKVVITARGREKLDEVVNRIREKGGEAIGITADVCSLEDTQRVFREALANFGDVDILINNAGIGEQKMIDETDDDWMKTVMDINLGGPMRYIREALKIFLPKNDGVIINISSVNGTRPFCGATYTSTKGALNTLTKNVAMRLIDTNIRCNAVAPGATVTPAHLANRAGEQPGGAKMLEYSGHYVYFPGPECEPIDQAYACLYLASKMGKAVRGQVLQVCNGAFL

SEQ ID NO: 971 - protein, 248 aa, Artificial Sequence
  Synthetic
MNYNPYSLDGKTILITGASSGIGKITAIECSKLGAKVIITARNKQRLNETFGLLEGIGHQMIIADLTQKNEIAFLVAALPKLDGFVCNAGITIRKPIRFITEEELHDVFEINTFSCFMLTKAIMKAKKVNQKGSIVFISSKAALQNTPGNSIYAASKAAVISFSRSCALEYATKGIRANAILPGMVETPFITNGMLSVEDIEKNKARYMLKRYGKPEEIAWLIIFLLSNGSGWITGSSFVIDGGGEVL

SEQ ID NO: 972 - protein, 242 aa, Artificial Sequence
  Synthetic
MKTALITGASRGIGEATAYQLAKEFDCVAIVSRNTDGKLNTVANQIHTTTNCECIPFTGDVSDFAFVEDCVQSLAASGHPVDTLVNNAGISLVGLFQDLTPEEFDRILRINVTSVYNTCHAVIPDMVRNQRGRILNISSVWGLVGASCEVAYSATKGAINSLTMALAKELAPSHIAVNAIAFGAVDTTMNGHLSVEEKKALCEEIPAEKMAAPEEAAACISHILAMPDYMTGEILKFDGGWI

SEQ ID NO: 973 - protein, 271 aa, Artificial Sequence
  Synthetic
MNNDWLELEGKTVIVTGAASGIGKAVAQEFLNIGANVVISDMAENAPEMDAKEGQLLYVRTDVTKVSDVEAMVAKTIETFGTIDVLVNNAGINIPRLLVDPKDPKGQYELDEAVWDKVCNVNLKGVFFCAQAVGRILVEKGEGVIINMSSESGLEGSEGQSVYAATKNAVNSLTRSWAKELGKQGVRVVGVAPGIMEATGLRTIGYETALAYTRGITVEQLRAGYSKTSTIPLGRSGKLSEVADLCVYLASKRSSYVHGVTVNVAGGKTRG

SEQ ID NO: 974 - protein, 256 aa, Artificial Sequence
  Synthetic
MNLNGKTALVTGSTSGIGLGIAKVLAQAGAQLVLNGFGDSTSARAEVAALGKIPGYHDADLRDVGQIEAMMRYAESEFGGVDIVINNAGIQHVAPVEQFAVEKWNDILAINLSSVFHTSRLALPGMRERNWGRIINIASVHGLVASKEKSAYVAAKHGVIGFSKTLALETARTGITCNAICPGWVLTPLVQQQIDKRIAEGADPEQARAQLLAEKQPSGEFVTPQQLGEMALFLCSDAAAQVRGAAWNMDGGWVAQ

SEQ ID NO: 975 - protein, 248 aa, Artificial Sequence
  Synthetic
MKLLEGKTALITGAARGIGKAIALKFAQEGANIAFTDLVIDENGKATEAEIAALGVKAKGYASNAADFAQTEEVVGQIHKDFGSIDILVNNAGITKDGLMLRMSEQQWDAVINVNLKSAFNFIHAVLPIMMRQRSGSIINMASVVGVHGNAGQANYASSKAGLIALSKSIAQEVGSRGIRANAIAPGFIETAMTAALPDDVRAEWTKKIPLRRGGKVEDIANVATFLASDMSSYVSGQVIQVDGGMNM

SEQ ID NO: 976 - protein, 242 aa, Artificial Sequence
  Synthetic
MKKTIVITGASRGIGKAIAIELAGKGTNIVINCVNNVDKLNEVRSIIEEKGSVCETFIGDMGNYSDVQKMFDMCLQCFGQVDVLINNAGISVVGLFQDMGEDEWHRICNTNIDSVFNCCHFAVKDMMKRHCGKIINISSVWGLYGASCEVAYSATKGAVNSFTKALAKELAPSGIQVNAVACGAIDTEMNGHLSDYDKAELAEEIPAGRFGTPQEVAELVKSLSGINNYLTGQIITLDGGWI

SEQ ID NO: 977 - protein, 271 aa, Artificial Sequence
  Synthetic
MSESWLNLEGKTVIVTGGASGIGKAVAQEFLSVGANVAISDMAPEAPEMEAEEGKFLYVKTDVTKPADVEAMVEKVKETYGTIDVLVNNAGINIPRLLVDPKDPKGQYELDEAVWDKVCNVNLKGVFFCAQAVGRVLVEKGSGVIINMSSESGLEGSEGQSVYAATKNAVNSLTRSWAKELGKQGVRVVGVAPGIMEATGLRTIAYESALAYTRGITVDDLRAGYAKTSTTPLGRSGKLSEVADMCVYLASDRASYVHGVTINVAGGKTRG

SEQ ID NO: 978 - protein, 256 aa, Artificial Sequence
  Synthetic
MEAKMLEGKTAIITGASYGMGQTMADLFAEEGANVVLTARGQEKLDEAVKNIREKGGNAVGVVADVCSTEDTRRVIDTALKQFGDLDILINNAGIGEQKMIDETDDDWMRFVMDTNLGGPMRYIREALKVFLPKDDGVIINISSVNGTRPFCGATYTSTKGALNTLTKNVAMRLVDTNIRCNAVAPGATVTPAHLANKAGEQPGGAKMLEYSGHYVYFPGPECDPMDQAYACLYLASKMGKAVRGQVIQVCNGAFL

SEQ ID NO: 979 - protein, 248 aa, Artificial Sequence
  Synthetic
MCTPCSLQGKTILVTGASSGIGRETAIACSEAGARVILTGRNEQRLAETYASLKGGDHLQIAADTNDEEQFVHLVNALPPVQGAAFCAGIVTMTPFLFISRQEMENIFNTNFFSPVLLAQKLIKAKKLQKESTIVFVSSIVGPVVAQTGNSIYAASKGALTAIVRNMALELAAKKIRVNCVLPGTTDTPMIRTHNVTEDSLSEEAREVPLKRLGHPRDIANAILYLLSDASEWMTGTELIIDGGATLR

SEQ ID NO: 980 - protein, 242 aa, Artificial Sequence
  Synthetic
MKKTIVITGASRGIGKAIAIELAGKDTNIVINCVNNVDKLNEVKSIIEEKGSVCETFIGDMGNYSDVQKMFDMCLQRFGQVDVLINNAGISVVGLFQDMGENEWHRICNTNIDSVFNCCHFAVKDMMKQHCGKIINISSVWGLYGASCEVAYSATKGAVNSFTKALAKELAPSGIQVNAVACGAIDTEMNGHLSDDDKASLAEEIPAGRFGSPQEVAKLVKSLSGMNSYLTGQIITLDGGWI

SEQ ID NO: 981 - protein, 271 aa, Artificial Sequence
  Synthetic
MDFFKGKTVVVTGASSGIGRALAEYFAAAGANAVLGARHEDALREIVGRIGAAGGHAAYAVCDVTREADCKRLIDTAVDTFGGVDVLICNAGISMRALFDEVDLAVLHKLMDVNFWGCVNCTKYALPYIQRVHGSIVGVSSVAGIHGLPGRTGYSASKYAMTGFLETIRIENCKKGVHVMIACPGFTASNVRFSALTADGSQQGETPREEGKMMTAEEVARIIARAVVRRKRLCLMEFQGRATHFVKKFWPSLLDRLFYWYMSKEPDSPFK

SEQ ID NO: 982 - protein, 256 aa, Artificial Sequence
  Synthetic
MNLNGKTALVTGSTSGIGLGIARVLAKAGAQLILNGFGDSDAAREEIARLGKKPGYHDADLRDALQIDAMMRYADTQFGGVDILINNAGIQHVAPVEAFPVEKWNDIIAINLSSVFHTSRLALPAMREKNWGRIINIASVHGLVASKEKSAYVAAKHGVVGFTKSLALETARTGITANAICPGWVLTPLVQQQIDKRIAEGVPADRAREQLLAEKQPSGEFVTPEQLGELALFLCSDSAVHVRGAAWNMDGGWVAQ

SEQ ID NO: 983 - protein, 248 aa, Artificial Sequence
  Synthetic
MGLLTGKTALITGAARGIGKAIALKFAEEGANIAFTDLVIDENGKATEAEIAAKGVKAKGYASNAADFAQTEEVVKLVKEDFGSIDILVNNAGITKDGLMLRMTEAQWDAVIAVNLKSAFNFIHACVPVMMRQRKGSIINMASVVGVHGNAGQANYAASKAGLIALAKSIGQEMGPKGIRANAIAPGFIDTAMTQALPENIRKEWISKIPLRRGGTVDDIAACATFLASDMSSYISGQVIQVDGGMNM

SEQ ID NO: 984 - protein, 242 aa, Artificial Sequence
  Synthetic
MKTILITGASHGIGKAIAEKLAACGMRLFLNCRSSKETLYEYAVKLSETYHVPCTPLFYDVSDHKQVHAMFEEICALGESIDILINNAGISHIGLLQDMSIEEWNQVLNTNLTSAFSCSKYAIPDMITRKQGKIINISSIWGCSGASCEVAYSASKGGLNLFTQALAKELAPSNIQVNAIACGVIDTRMNACFDAEERSELENEIPAGRFAAPSEVADFVQQLIDAPSYLTGQIISFDGGYL

SEQ ID NO: 985 - protein, 271 aa, Artificial Sequence
  Synthetic
MDWIYGKTVLITGASSGLGRALSVHLIKEQNCKVIGIGQSEKKMESLKEELTYLRDEFEYRIFDVSMEENWKMFADELLAEDKRVDLLINNAGMLPPFEKVVNYTEEQVRECMDVNFHGCRYAVNYMLPILRKSTMAGIVNISSSDALAAIIGTGIYSASKAALKAYTEVLIAELGREMYISYVCPGFIRTEIFRNQYVISESRLIKMASTKVDKVARKIVKKIAKQKARIIVGKDAKFMNFTSKFFPVLGLKLYEQLIKHSKVEMFENLR

SEQ ID NO: 986 - protein, 256 aa, Artificial Sequence
  Synthetic
MEKQMLENKVAIITGASSGIGQAIAQLFAEEGASVVLIGRNEKNLNDTVNGIKAKGQKAIGVLADVTSKDDIAKVFDETIQTFGDLDILVNNAGISDEYAIDETTDEWLNHVLDVNLNAPIRYAREALKYFMPKNDGVIINITSVNGDRPIGGAAYTSSKGALNTLTKNIAMRLSDTNIRCNAVAPGATLTPMHFAHLRGENPGGNLMLEFGKKYCNWNLPETNPLDQAYACLYLASKMGKAVKGQVLQVCNGAFL

SEQ ID NO: 987 - protein, 248 aa, Artificial Sequence
  Synthetic
MGLLDGKTAIVTGAARGIGKAIALKFAQEGANIAFTDLVIDENAEATAKELEALGVKAKAYASNAANFEDTANVVAEIHKDFGRIDILVNNAGITRDGLMMRMSEGQWDAVIGVNLKSAFNFIHACTPVMMKQRSGSIINMASVVGVHGNAGQSNYSASKAGMIGLAKSIAQELGSRGIRANAIAPGFIITDMTAGLPEEVKAEWAKKIPLRRGGTPEDVANIATFLASDMSSYVSGQVIQVDGGMNM

SEQ ID NO: 988 - protein, 242 aa, Artificial Sequence
  Synthetic
MNIEKKKRVAVVTGSSSGIGEAIARELAGNGITVVLLARRFERIDVLASELGHGAIAIKADVTERESIVAAANQVEQALGGVDILINNAGVMLTGPFDSSQRDEHRQMIETNLLGAMTVTEVFLPQLRRNKGDLVNISSVAGRVAPSGFAAYAATKWGINGWSEALRVELQPDIRVMVIEPGAIATELADHITHEESQSVAKSALDWAIPPSDIAEVIAFAVNLPKRTSINEILIRPTVQMM

SEQ ID NO: 989 - protein, 271 aa, Artificial Sequence
  Synthetic
MSVHGKKQKKRQNSYVKATESGRKMMLKGKIAVVTGASRGIGRAIAVKLAAEGAVVIINYNRSKDEAEKVKEQIEASGGQVKLIQCNVASFESCEKMFEEVMKEFGRIDILVNNAGITKDGLLMKMSEDDFDAVVDTNLKGAFHCIRFVSRAMIRQRSGRIINISSVSGVLGNAGQANYAASKAGVIGLTKSAARELAGRKITVNAVAPGFIRTEMTAVLSEKVKEKAVLQIPMERFGEAEDVAQAVAFLASEQAGYITGQVLCVDGGMAM

SEQ ID NO: 990 - protein, 256 aa, Artificial Sequence
  Synthetic
MEQQMLKDKVAIITGASYGMGRTMAELFAEEGAAVVITARGKEKLDAVVEGIRERGGKAVGIVADVCSTEDTKRVFETALKEFGDVDILINNAGIGEQKIIDETDDDWMMYVMNINLGGPIRYIREALKIFLPKNDGVIINVSSVNGTRPFCGAAYTSTKGALNTLTKNVAIRLIDTNIRCNAVAPGATVTPAHLTNKAGEQPGGAEMLKYSGHFVYFPGPECDPMDQAYACLYLASKMGCHVKGQVLQVCNGAFL

SEQ ID NO: 991 - protein, 248 aa, Artificial Sequence
  Synthetic
MKLLEGKTAIVTGAARGIGKEIALRFAREGANIAFTDLVIDENGKKTEEEIAALGVKVKGYASNAADFAQTEEVVKQIHADFGSIDILVNNAGITKDGLMMRMTEAQWDAVIAVNLKSAFNFIHAVLPVMLRQRSGSIINMASVVGVHGNAGQSNYAASKAGLIALAKSVAQEVGSRGIRANAIAPGFIETAMTAALPEDVRAEWCKKIPLRRGGKVEDIANVATFLASDMSGYVTGQVIQVDGGMNM

SEQ ID NO: 992 - protein, 242 aa, Artificial Sequence
  Synthetic
MLLKGKTALITGAGSGIGKAIALKMTEEGAEVILAGRKEASLQNVQEQIVQKGGRAGYFLCDVRKPDEITEMTEKIMKQYGKIDILVNNAGISKEMPFLDMPVEVFDEICETNLRSVMLMMKAVLPYMKEQKSGNVVNIGSGAAIRGLPGSAAYSVSKAGVICLTQAVGDEVRPFGIRINAICPGPVDTELFQKSERRNYILSAGGDLFKPETVANGVAFLASDLSEGMNSQVLIMRGFNRW

SEQ ID NO: 993 - protein, 271 aa, Artificial Sequence
  Synthetic
MDWIYGKTILITGASSGLGRAMTLQLIREHGCMVLGIGQSEEKMKSLIEELSYLRDQFKYWIFDVSQEENWNTFREELTYKNINVDLLINNAGMLLPFEKSVNYTEEQVKRCMDVNFNSCRYSINAMLPILRKSTMAGIVNVSSSGALAPLVGTGVYSASKAAVKAYTETLIGELGREMYIGYVCPGFIMTDIFRSQYYKTESKLMKFIANNVDKVAAKIIKKIIKQKNRIIVGKDAKFMNFTSKFFPILGLKFYEQFIKHTKIDIFENVR

SEQ ID NO: 994 - protein, 256 aa, Artificial Sequence
  Synthetic
MEAQMLKDKVAIITGASYGMGRSMAELFAEEGAAVVITARHQEKLDAVVESIRQKGGKAVGVVADVCSTEDTKRVFKTALKKFGDVDILINNAGIGEQKMIDETDDDWMMYVMNTNLGGPMRYIREALKIFLPKNDGVIINVSSVNGNRPFCGATYTSTKGALNTLTKNVAMRLIDTNIRCNAVAPGATVTPAHLANKAGEQPGGAEMLKYSGHFVYFPGPECDPMDQAYACLYLASKMGRHVKGQVLQVCNGAFL

SEQ ID NO: 995 - protein, 248 aa, Artificial Sequence
  Synthetic
MSDFSNKVVCITGAAGGMGRAVTTELAKRHADLILCDLQESEKFTKFMEGLKAEYGVQVYPFYFNLEDEESIKEGTKAIKALKIKIDILVNNAGIPHLAILPFTKMSDVKKVFQVNYFAQLQITQSLLGIIKKNENSCIINLSSVAGIDGNIGNSVYGATKASMALFTKVLSKELASSHIRVNAVAPGLTNTKFATMMGQKAIESMEQISTMGRLGNPQEIANTIVFLASDEASFINGQIIRIDGGLK

SEQ ID NO: 996 - protein, 242 aa, Artificial Sequence
  Synthetic
MKTALITGASRGIGEATAYQLAKEYDCVAIMSRNTDGKLNAVANQIHTTTNCECIPFTGDVSDFAFVEDCVRSLATSGHPVDTLVNNAGISLVGLFQDMTPEEFDCILRINVTSVYNTCHAVIPDMVRNQRGRILNISSVWGLVGASCEVAYSATKGAINSLTMALAKELAPSHIAVNAIAFGAVDTTMNGHLSVEEKKALCAEIPAEKMAAPEEAAASISHILAMPDYMTGEILKFDGGWI

SEQ ID NO: 997 - protein, 271 aa, Artificial Sequence
  Synthetic
MERTQVILITGASSGFGKVTAQALAGKGYVVYGTSRRIANGNIGQVRMLIADVTDENSVRSAVNRIMDEQGHIDVLINNAGMGIGGALEMATDEEISSQMDTNFMGMVRMCRAVLPIMRKQRQGKIINISSIAGRIAVPYQGFYSASKFAIEGYSEALSMEVYPFGIKVCVVEPGDFNTGFTASRNISPATLACPDYGERFKRTLKIIEEAETNGCPPSKLAAAICKLIEKKNPPFRTLTGPWTQVAFARFKGWIPGKVIRYALRSFYEIK

SEQ ID NO: 998 - protein, 256 aa, Artificial Sequence
  Synthetic
MKEYVLITGATSGIGYEFAKIFAENKYNLILSGRNIKVLENMKEDMEEKYKIMVYIFEKDLSKKGTAEELYQEIKNNNINVDILINNAGFGYVNEFINEEITKDYEMMNLNMSSLTILTKLCGREMAKRKHGKILNVASTGAYHPGPYTAVYYASKAYVLSLTEAIAHELKTYNVTVTALCPGATKTNFCKREGKEDNPKAKDPAFVAKKGYDALMKGKGNVIPGIENKLLVMIPRKIAAPFIGKYQMGLKKKSKQ

SEQ ID NO: 999 - protein, 248 aa, Artificial Sequence
  Synthetic
MKLLEGKTAIITGASRGIGKAVALEFARQGANIAFTDLRYDEIAQETEKEIAALGVKAKMFASNAADFAATNATVDEIVKEFGRVDILVNNAGITKDTLLMRMSEEQWDAVINVNLKSVFNFTKAVSAIMLRQKSGSIISMSSVVGVSGNAGQANYAASKAGIIGFTKSVAKELGSRNIRANAVAPGFIITDMTAQLSEDVRKEWAAKIPLKRGGTPEDIAKVCVFLASDLSAYVTGQTIHVCGGMNM

SEQ ID NO: 1000 - protein, 242 aa, Artificial Sequence
  Synthetic
MLKGKNVIVTGAAKGIGKAIALAFAKEGCNIVLNYHSHLDEETVKEIEDYGVICKPVQGDVSDFAFAADMIKEVKKELGSIDVLVNNAGITKDMLLMRMTEEQFDDVINTNLKGTFNMIRHVSNVMLKQRSGAIINMASVVGINGNIGQANYAASKAGIIGLTKSTAKELASRGITCNAIAPGYVETDMTAVLKEDVQNAILSAIPLKRGGKVEDIARAVVFLAENDYITGQVLNVDGGMVM

SEQ ID NO: 1001 - protein, 271 aa, Artificial Sequence
  Synthetic
MKTLRDKVIVITGASSGIGEAMAKEYAAQGAKVVLGARSVQKLQLLAGDIRSTGGRAAYCGVDVTKPAECKELIDTAVREFGGIDVLICNAGISMRAIFDDVELDVLHKLMDVNFWGTVYCCKHALPYLQASKGSVVGISSVAGLHGLPGRTGYSASKYAMTGFLETLRIENLKKGLHVMIACPGFTASNVRFSALTADGSQQGETPRDEAKMMTAEQVARIVAKGILRRKRLCLMEIEGRATHFVKKFAPAFLDRMFYLVMSREPDSPLK

SEQ ID NO: 1002 - protein, 256 aa, Artificial Sequence
  Synthetic
MDRKMLDGKVAIITGASYGMGQTMAELFAEEGASVVLTARRQDELGKVVEEIRKKGGKAIGVAADVTSPEDTKRVFETTLKEFGDLDILINNAGIGEQKLIDETDDEWLNHVSAVNLAGPVRHIRQALKIFLPKNEGVIINITSVNGTRPFCGAAYTATKGALNTLTKNVAMRLIDTNIRCNAVAPGSTVTPMHIANKNQEHPGGKGMLEYSQHYVYFPGPECDPIDQAYACLYLASKMGKAVKGQVLQVCNGAFL

SEQ ID NO: 1003 - protein, 248 aa, Artificial Sequence
  Synthetic
MGLLDGKTAIVTGAVRGIGKAIALKFAAEGANIAFTDLVIDENAEKTVKELEAMGVKAKGYASNAANFEDTAKVVEEIHKDFGRIDILVNNAGITRDGLMMRMSEQQWDMVINVNLKSAFNFIHACTPVMMRQKSGSIINMASVVGVHGNAGQANYAASKAGMIALAKSIAQELGSRGIRANAIAPGFILTDMTAALSEEVRAEWAKKIPLRRGGTPEDVANIATFLASDMSSYVSGQVIQVDGGMNM

SEQ ID NO: 1004 - protein, 242 aa, Artificial Sequence
  Synthetic
MKKTVLVTGSSRGIGRAVALKFASCGYRVVINCARSADRMEEVKKEVEALGAECLAVQADVGNPEDCKRLFQEIGSRFGHVDVLVNNAGISIIGLLQDLSFEDWNRIVSANLSSVFHCAKLAIPGMIHNHSGKIINISSVWGVCGASCEAAYSATKGGVNGLTMALAKELAPSNIQVNAIACGAIDTEMNGFLSEEEHAMLLDEIPAGRMGKPEEVADLVMKLIEAPEYLTGQIIKMDGGWI

SEQ ID NO: 1005 - protein, 271 aa, Artificial Sequence
  Synthetic
MSESWLGLEGKTVIVTGGASGIGKAVAQEFLNVGCNVVVSDMAPEAPEFDTAAGRFHYVKTDVTSAEDVDAMVKEVVDTFGTVDVLVNNAGINIPRLLVDPKEPKGQYELDEAVWDKVCGVNLKGVFFCAQAVGRILVEKGEGVIINMSSESGLEGSEGQSVYAATKNAVNSLTRSWAKELGKQGVRVVGVAPGIMEATGLRTLAYESALAYTRGITVDDLRAGYSKTSTTPLGRSGKLSEVADMCVYLASQRSSYVHGVTINVAGGKTRG

SEQ ID NO: 1006 - protein, 256 aa, Artificial Sequence
  Synthetic
MEKEMLKGKVAIITGASYGMGQTMAELFAEEGAAVVLTARGKEKLDRAVEGICAKGGRAVGVVADVCSTEDTKRVFKTALREFGDMDILINNAGIGEQKMIDETDDDWMLYVMNTNLGGPMRYIREALKIFMPKNDGVIINISSVNGERPFCGATYTSTKGALNTLTKNVAMRLIDTNIRCNAVAPGATVTPAHIANKAGEQPGGAKMLEHSGHFVYFPGPECDPMDQAYACLFLASKMGRHVKGQVIQVCNGAFL

SEQ ID NO: 1007 - protein, 248 aa, Artificial Sequence
  Synthetic
MKKTAFVTGATSGFGEAIARRLSKEGYKIVALARREDRLKKLASELGDTHIIVADIRDKEAVFGAVDSLPDKFKDIEVLVNNAGLALGQEKTIDAKVEDFETMIDTNVKGLIYSTKAVLPLLYKQEKGYIFNLGSTAGSWPYPGSNVYGATKAFVKQFSLNLRNDLVGTNIRVTNIEPGLCKTEFSEVRFKGDKAKADSIYEHTNFITSEDIATILVNCLNMPGSVNINRVEVMANTQTWAGLAIEKF

SEQ ID NO: 1008 - protein, 242 aa, Artificial Sequence
  Synthetic
MLKGKTAIVTGAAKGIGKAIAIAFAKEGCNIVLNYHSNVSDETIEEIEDCGVKCMPVQGDVSDFDFAKNFIKDVKKEFGTIDVLVNNAGITNDMLLMRMSEEQFDSVINTNLKGSFNMIRHASSVMLKQRSGAIINMSSVSGVAGNIGQANYAASKAGVIGLTKATAKELAQRGVTCNAIAPGFIETDMTAVLADETKAAILNSIPLSRAGKPEDVANAAVFLAKNNYITGQVLNVDGGMIM

SEQ ID NO: 1009 - protein, 271 aa, Artificial Sequence
  Synthetic
MDFFKRKTVVVTGASSGIGRALAEYFAAAGANAVLGARHEEALKQIVDGIAAQGGHAAYAVCDVTREADCKRLIETAVETFGGVDVLICNAGISMRALFDDVDLEVLHKLMDVNFWGCVNCTKYALPAIQKSRGSIVGVSSVAGIHGLPGRTGYSASKYAMTGFLETIRIENRRKGVHVMIACPGFTASNVRFSALTADGSQQGETPREEGKMMTAEEVARIIARGIVRRKRLCLMEFQGRATHFVKKLWPSLLDRLFYWYMAKEPDSPFR

SEQ ID NO: 1010 - protein, 256 aa, Artificial Sequence
  Synthetic
MKTPVAVITGASSGIGMEFARRLSEKGYECLLVARSEDKLNALRDSLPAASHVLALDLGCADSPARVLEWLDANAKEPVILINNAGFGAFGPMIEADEARLLNMIDLNVRSHTALAVAIARRMHASGSGRILNVASTAAFQPCPYMGVYGATKAYVLSFSEALAEELRRTAVSVTALCPGPTRTGFGTSAGLLEDSPFDRYAADTAQVVEAGLEALFSGRTVAVTGWLNLLGSLLSRFVPRAVVRRISGDMLRRMR

SEQ ID NO: 1011 - protein, 248 aa, Artificial Sequence
  Synthetic
MGLLDGKTAIVTGAARGIGKAIALKFAAEGANIAFTDLVIDENAENTAKELEAMGVKAKGYASNAANFEDTAKVVEEIHKDFGRIDILVNNAGITRDGLMMRMTEQQWDMVINVNLKSAFNFIHACTPIMMRQKSGSIINMASVVGVHGNAGQANYSASKAGMIALAKSIAQELGSRGIRANAIAPGFIMTAMTDALSEEVKAEWCKKIPLRRGGTPEDVANIATFLASDMSSYVSGQVIQVDGGMNM

SEQ ID NO: 1012 - protein, 242 aa, Artificial Sequence
  Synthetic
MKKTVLVTGSSRGIGRAVALKFASCGYHVVINCARSTERMEEVKKEVEVLGAECLAVQADVGDPDDCKRLFKEIESRFGHVDVLVNNAGISIIGLLQDLSFEDWNRILSANLSSVFHCTKLAIPGMIHNHSGKIINISSVWGVCGASCEAAYSATKGGVNGLTMALAKELAPSGIQVNAIACGAIDTEMNGFLSDEEHEMLLDEIPTGRMGKPEEVADLVMKLVEAPDYLTGQIIKMDGGWI

SEQ ID NO: 1013 - protein, 271 aa, Artificial Sequence
  Synthetic
MGESWLELEGKTVIVTGAASGIGKAVAQEFLNVGANVVISDMAEKAPEMDAEEGKLLYVRTDVTKAADVEAMVAKVKETYGTIDVLVNNAGINIPRLLVDKKDPKGQYELDEAVWDKVCNVNLKGVFFCAQTVGRVLVEKGEGVIINMSSESGLEGSEGQSVYAATKNAVNSLTRSWAKELGKQGVRVVGVAPGIMEATGLRTIGYETALSYTRGITVEDLRAGYAKTSTTPLGRSGKLSEVADMCVFLASKRASYVHGVTINVAGGKTRG

SEQ ID NO: 1014 - protein, 256 aa, Artificial Sequence
  Synthetic
MEQQMLKDKVAVITGASYGMGRTMAELFAEEGAAVVITARHAQQLNEVVDGIRAKGGKAVGVVADVCSTEDTKKVFDTALKEFGDVDILINNAGIGEQKMIDETDDDWMLYVMNTNLGGPMRYIREALKIFLPKNDGVIINISSVNGTRPFCGATYTSTKGALNTLTKNVAMRLIDTNIRCNAVAPGATVTPAHLANKAGEQPGGAEMLKYSGHFVYFPGPECDPMDQAYACLYLASKMGRAVRGQVIQVCNGAFL

SEQ ID NO: 1015 - protein, 248 aa, Artificial Sequence
  Synthetic
MIRLEDKNAIVTGANRGLGKAFVEGLAQAGCNVWGVMRTESEEFLAFAKKLEKENNVFVEPIYADLTQERSIKTAYELINKEKKTIDILINNAGIAHMGLFQMTKMEFVHQVYQVNVFAPMIWSRSVLRNMIRQKKGRIINVASTAAEEVYEGNSVYGASKAALEAFTKSFGAEVYKYGVTVNAIAPGLINTDMSVVFEGKDPKEPIRHTALGRKIEPKEIVDVVLNMLSDDMSIVNGTVVTINGGHK

SEQ ID NO: 1016 - protein, 242 aa, Artificial Sequence
  Synthetic
MAQTIVITGASRGIGRAIALRLAQKDINIVINCIHHEELLLEVRDAVVERGACCLPFIGDISDYSTAAALFDAVHTQFGSVDILINNAGISDIGLFQNLTRSGWDRIMNVNAGSVYNCCHFAIPDMIQAHRGRIINISSVWGIAGASCEAAYSASKGAVNTLTKALARELAPSGIQVNAIACGTIDTEMNAFLSEEDRLALEDEIPAGRFGTVQEAADMVYLLCQAPDYLTGQIITLDGGWT

SEQ ID NO: 1017 - protein, 271 aa, Artificial Sequence
  Synthetic
MRHQSYQRAIITGASSGLGEEFAYQLAPYVDELILIARRRDRLTIVGESSRRINPALQVSCLPGDLTDPSFMIPLIHMLTGLPSARTLLINNAGMGDYGEFSTADWDKIESMIVLNIFTLTKLCHSLIPTLETAGGGIINISSLASALPIPDFAVYAASKAYVLSLSEALRLELKEKNINVLAVCPGPVHTEFGQIARRPGFTGDMMPGKQMFDTSRERVVSEALSAMAKNKSRIYPGGPIKWSHILLSLLPAPVIRWVMGRRPRRSLLQT

SEQ ID NO: 1018 - protein, 256 aa, Artificial Sequence
  Synthetic
LEKEMLKGKVAIITGASYGMGQTMAELFAEEGAAVVLTARGQEKLDEVVQGIRAKGGRAVGVVADVCSTEDTQRVFETALREFGDVDILINNAGIGEQKMIDETDDDWMLLVMNTNLGGPMRYIREALKIFMPKNDGVIINISSVNGERPFCGATYTSTKGVLNTLTKNVAMRLIDTNIRCNAVAPGATVTPAHIANKAGEQPGGAKMLEHSGHFVYFPGPECDPIDQAYACLFLASKMGRHVKGQVIQVCNGAFL

SEQ ID NO: 1019 - protein, 248 aa, Artificial Sequence
  Synthetic
MGLLTGKTAIVTGAARGIGKAIALKFAAEGANIAFTDLVIDENGLNTEKEIAAFGVKVKGYASNAANFEDTAKVVEQIKEEFGTIDILVNNAGITKDGLMMRMSEAQWDAVIAVNLKSAFNFIHACTPIMMRQKSGNIINMASVVGVHGNAGQCNYSASKAGMIGLAKSIAQELGSRGIRANAIAPGFIITEMTAQLSDEVKAEWNKRIPLRRGGTPEDVANTALYLASDLSAYVSGQVIQVDGGMNM

SEQ ID NO: 1020 - protein, 242 aa, Artificial Sequence
  Synthetic
MLKGKTAVVTGGSRGIGEAIVYKLASMGANVAVIYAGSRTAAERVCEKCKQEYSVEAKAYQCNVADFSAAKETVAKIKTEFGTAQILINNAGITRDGLLAMMKEEDFDSVLDTNLKGAFNMIRHMTGLFIRAREGCIINMASVAGIMGNAGQCNYSASKAGLIGLTKSVAKELAPKGIRCNAVAPGFIATDMTGNQTDNPLLNMIPLGKMGETDDVADAVAYLITAKYVTGEVLRIDGGLAM

SEQ ID NO: 1021 - protein, 271 aa, Artificial Sequence
  Synthetic
MSESWLKLEDKTVVVTGGASGIGKAVAQGFLNVGANVVISDMAPEAPEMDAAEGKLLYVKTDVTKAADVEAMVQKAKETFGTIDVLVNNAGINIPRLLVDPKDPKGQYELDEAVWDKVCNVNLKGVFFCAQAVGRVLTEKGSGVIINMSSESGLEGSEGQSVYAATKNAVNSLTRSWAKELGKQGVRVVGVAPGIMEATGLRTIAYESALAYTRGITVDDLRAGYAKTSTTPLGRSGKLSEVADMCVYLASERASYVHGVTINVAGGKTRG

SEQ ID NO: 1022 - protein, 256 aa, Artificial Sequence
  Synthetic
MEKEMLKNKVAVITGASYGMGQTMAELFAKEGASVVLTARGREKLDAVVEGIRAKGGKAVGVVADVCSTEDTQKVFATALREFGDVDILINNAGIGEQKMIDETDDDWMWMVMDTNLGGPMRYIREALKIFLPKNDGVIINISSVNGERPFCGATYTSTKGALNTLTKNVAMRLIDTNIRCNAVAPGATVTPAHIANKAGEQPGGAKMLGYSGHFVYFPGPECDPMDQAYACLYLASKMGRHVKGQVIQVCNGAFL

SEQ ID NO: 1023 - protein, 248 aa, Artificial Sequence
  Synthetic
MGLLTGKTAIVTGAARGIGKAIALKFAAEGANIAFTDLVIDENGLNTEKEIAAFGVKVKGYASNAANFEDTAKVVEQIKEEFGSIDILVNNAGITKDGLMMRMSEAQWDAVIAVNLKSAFNFIHACTPIMMRQKSGNIINMASVVGVHGNAGQCNYSASKAGMIGLAKSIAQELGSRGIRANAIAPGFIITEMTAQLSDEVKAEWNKRIPLRRGGTPEDVANTALYLASDLSAYVSGQVIQVDGGMNM

SEQ ID NO: 1024 - protein, 242 aa, Artificial Sequence
  Synthetic
MKNVLVTGASHGIGKAIAEAFASKGHRVFLNCKTSKNEIKEMAEKWSEKYETQCFPLVYDVADHEQVTDMFKEIHTLCDGIDILINNAGISYIGVLDAMSIDSWNNVIQTNLTSVFSCCKCAMPSMIHKKQGCIINISSVWGNVGASCEVAYSASKGGVNSFTKALAKELAPSNIAVNAIACGTIDTRMNACFSEEERMALAEEIPAGRFGTTEEVATLALQLAESPTYLTGQILTMDGGWC

SEQ ID NO: 1025 - protein, 271 aa, Artificial Sequence
  Synthetic
MERTQVILITGASSGFGKVTAQTLAEKGYVVYGTSRRIANGNIGQIRMLIADVTDENSVRSAVNRIMEEQGHIDVLINNAGMGIGGALEMATDEEISSQMDTNFMGMVRMCRAVLPIMRKQRQGKIINISSIAGRIAVPYQGFYSASKFAIEGYSEALSMEVYPFGIKVCVVEPGDFNTGFTDNRNISEATRVNTDYKESFLKSLEIIEKEERNGCHPKKLGHAICKIVACKNPPFRTKVGPWIQVTFAKSKKWLPDVVMQYALRIFYAIQ

SEQ ID NO: 1026 - protein, 256 aa, Artificial Sequence
  Synthetic
MDRLKDKVAIITGASSGMGKSDAFLFAAEGAKVVIAARRTALLEEIAEEIRAKGGEVLVVTHDVSQEDSWKNVIAVTLEKYGRIDILINNAGMLRRCDNIMEEDVENIRAVMDVNFYGQFLGIKYAAKAMVEGGHGGSIVNLSSVNAVGGWQMNAAYSAAKGAVSAISRTAAVDLAPYNIRVNCVLPGPIDTPMSIGCVDVPEINADMCKAIPMKRWGQPEEVANAVLFLASDEASYITGLDLLVDGGETRYLYMK

SEQ ID NO: 1027 - protein, 248 aa, Artificial Sequence
  Synthetic
MIVLVTGATAGFGECITRRFIENGHKVIATGRRQERLQELKEELGDRLYTAQLDVRNRASIEEMMDALPAEWRNIDVLVNNAGLALGLEPAHKASIEDWENMIDTNNKGLVYMTRAVLPGMVERNRGHIINIGSTAGSWPYAGGNVYGATKAFVRQFSLNLRTDLHGTAIRVTDIEPGLVGGTEFSNVRFKGDDAKAEKAYENTTALTPQDVTEAVWWVASLPAHVNINTLEMMPVTQSFAGLSIHRS

SEQ ID NO: 1028 - protein, 242 aa, Artificial Sequence
  Synthetic
MLRTILITGASSGIGAATAIAFAKPNNRLILVSRKNREGLKKIEDEGRERGAEVLSILADVSDYEACKLLVQQAVERFGTIDLLVNDAGVSHIGLFQDMTPDEWQRVMNVNIGSVMNLCHLVIPSMVHRHHGRIINISSVWGNVGASCEAVYSASKGAINSFTKALAKELAPSNIQVNAIAFGAIETPMNAWLSKEEAEALADEIPAGREGTKEEAAQMICMVADAPDYLTGQIITMDGGWI

SEQ ID NO: 1029 - protein, 271 aa, Artificial Sequence
  Synthetic
MKPGKVILITGATSGFGRTASGMLSAAGHTVYGTGRSVQEGTRDDGVRMLRLDVTVPSSIEEAIGKIIAAEGRIDVLVNNAGAGIGGSLELATEEERRWQMETNFMGMTRVCSAVLPHMRRQRGGRIINISSIAGVVAVPYQGFYSASKFAIEGYSEALAVEVRRFGIRVCLVEPGDFRTGFTSSRKMSQATLDDPDYSASFRRTMAGVEKDETRGCDPARVGKVLCRLVVRRRPRFRTLTGSLLQTAFARVSRVLPGRLTQLLLTWFYSV

SEQ ID NO: 1030 - protein, 255 aa, Artificial Sequence
  Synthetic
MAKQRIIAITGASGGLAQEIVKQLSPSDGIILLGRDKDKLEKCYRHVENKTCLAIDLRDDNAIKKMVDYLYQRFGRIDVFINNAGFGEFKSYDHYTSQEIRDMFDINTFATMTFSRLMAEKMVEQGRGHIINIASMAGKIATANSSVYAATKFAVIGFSDALRLELADKGVYVTTVNPGPIETSFFDQADPSGAYLESVKKFVLSPKYVAKKIIRILGKNKREVNLPRLLAAAHKGYTLFPRISDKLATNVFNYK

SEQ ID NO: 1031 - protein, 248 aa, Artificial Sequence
  Synthetic
MIVLVTGATAGFGECITRRFVENGHKVIATGRRQERLQELKESLGDNVLIAQLDVRNRAAIEEMLASLPAEWRDIDLLVNNAGLALGLEPAHKASVEDWETMIDTNNKGLIYMTRAVLPGMVERNRGHIINIGSTAGSWPYAGGNVYGATKAFVRQFSLNLRTDLHGTAVRVTDIEPGLVGGTEFSNVRFKGDDNKAGKTYENTTALTPEDVTEAVWWVATLPAHVNINTVEMMPVTQSFAGLSVHRG

SEQ ID NO: 1032 - protein, 242 aa, Artificial Sequence
  Synthetic
MNKVIIVTGASKGIGKEISKELAKKGNTIIANYNKSEKEIKELQQELEKQNIKIDIYKADVSKREEVENLVKYTIQKYGKIDVLINNAGISQIKEFTQITDEDWNNMINTNLNSVFYMSQEACHNMIHNKKGCIINISSIWGITGASCEVHYSVSKAGVDALTKALAKELGPSNIRVNSIAPGIINTEMNAHLSEEEKQNIEEEIPLEKIGKAIDIERCVEWLIKDEYTTGQVISINGGWNI

SEQ ID NO: 1033 - protein, 271 aa, Artificial Sequence
  Synthetic
MKTLKDKVIVITGASSGIGEAMAREYAARGAKVVLGARSVQKLQLLAGEIRRHGGQAAYCGVDVTRPEECRGLIDTAVREFGGVDVLVCNAGISMRALFDDVELEVLHRLMDVNFWGTVYCTKYALPYLQASHGSLVGISSVAGLHGLPGRTGYSASKYAMTGFLETVRIENLKKGLHVMVACPGFTASNVRFSALTADGSSQGETPRDEAKMMTPEQVARIVIRGIEKRKRLCLMEAEGRATHFIKKFAPGFLDRMFYMVMAREPDSPLK

SEQ ID NO: 1034 - protein, 255 aa, Artificial Sequence
  Synthetic
MKEKLIFITGATSGIGEGCARKFAAMGSNLILNGRNTEKLEALKEELTAQGVEVLTLPFDVRDRETMRQAVDSLEGKWRNIDVLINNAGLVIGMDKEYEGSLNEWDIVIDTNIKALLAMTRMIVPGMVERGSGHIINIGSIAGDAAYAGGSVYCATKAAVKALSDGLRIDLVDTPLRVTNIKPGMVETNFSVVRFRGDKNKADAVYEGLKPLTGDDIADVVYYAASAPAHIQIAEVLVMPTYQATGTVCHRQKNI

SEQ ID NO: 1035 - protein, 248 aa, Artificial Sequence
  Synthetic
MIILVTGATAGFGESITRRFVANGHKVIATGRRQERLQELKDELGDSILTAQLDVRNRAAIEEMIANLPAEWREIDVLVNNAGLALGMEPAHKASVEDWENMIDTNNKGLVYMTRAVLPGMVERNRGHIINIGSTAGSWPYAGGNVYGATKAFVRQFSLNLRTDLHGTAIRVTDVEPGLVGGTEFSNVRFKGDDAKADKTYENANALTPEDITETVWWVANLPKHVNINTVEMMPVSQTYAGLSVHRG

SEQ ID NO: 1036 - protein, 242 aa, Artificial Sequence
  Synthetic
MKRAIIFGATGGIGRAIAENMAENGWSLYIHYNHNQQEAGKMVQKFIENYPDQEFFSLKLNFLAEDDVIKKIISNLLPISAVIFTQGITNYQFLGSQELDEIEKIIQINLLAPIKITSLLESQLLKQAHGRIIFIGSVYGGQASALESVYSASKGGLSSFVQGYAREVASANLTVNVIAPGAVDTPMNAIFDAETLNEVKNEIPAGRLADPKDISFWVENLLDERSDYLTGQTIYVDGGWLV

SEQ ID NO: 1037 - protein, 271 aa, Artificial Sequence
  Synthetic
MNTDWLDLENKTVIVTGAASGIGKAVAQEFLEVGANVVISDMADQAPEMRAEEGKLLYVKTDVTNPAQVEAMVEKTKETFGTIDVLVNNAGINIPRLLVDKNDPKGQYELDEVVWDKVCNVNLKGVFFCAQAVGRVLTEKGEGVIINMSSESGLEGSEGQSVYAATKNAVNSLTRSWAKELGKQGVRVVGVAPGIMEATGLRTLSYESALAYTRGITVDDLRAGYAKTSTTPLGRSGKLSEVADMCVYLASKRASYVHGVTVNVAGGKTRG

SEQ ID NO: 1038 - protein, 255 aa, Artificial Sequence
  Synthetic
MPKNVLITGATSGIGEATARAFAKEGENLILTGRRVERLQALKEELQATYPYQKVWTFALDVTDMDMVKDVCQAILKSVGQVHVLVNNAGLALGLTAYQDYEEWDLLTMIDTNVKGLMMVTRQILPSMVAANEGHIINMGSTAGIYAYAGAAVYSATKAAVKTFSDGLRIDTIATDIKVTTIQPGIVETDFSQVRFHGDKDKAAKVYQGLEALQAQDIADAVLYVTKQPRRVQISDMTIMANQQATGFTIHREED

SEQ ID NO: 1039 - protein, 248 aa, Artificial Sequence
  Synthetic
MKLLEGKVAIVTGAARGIGKAIALKFAAEGANIAFTDLVIDENGLATQKEIEALGVKAKGYASNAANFEETHNVVAEVVKDFGRVDILVNNAGITKDGLMMRMSEGQWDAVIGVNLKSAFNFIHACTPVMMKQRSGSIINMASVVGVHGNAGQSNYSASKAGMIGLAKSIAQELGSRGIRANAIAPGFIITDMTAGLPEEVKAEWAKKIPLRRGGTPEDVANIATFLASDMSSYVSGQVIQVDGGMNM

SEQ ID NO: 1040 - protein, 242 aa, Artificial Sequence
  Synthetic
MKKTAVVTGASRGIGRAAAIALAKDFNVVVNCRKNIDLARKTAEEIIKNGGSALVYRADVSVFDEAHALCKFAVKNFGGIDVLVNNAGIAQQKVFCDITEDEFKNMMQTNVGSVFNMCKAVMGEMIGKKSGKIINISSVWGICGASCEVHYSASKAAVIGFTKALAQELAPSGINVNCVAPGVVDTDMCKFDGETKKLVTEDIPLGKIASPEKIADTIAFLASDKADYITGEVINVSGGFVV

SEQ ID NO: 1041 - protein, 271 aa, Artificial Sequence
  Synthetic
MDFFKGKTVVVTGASSGIGKALAEYFAAAGANVVLGARHEEKLKEIVHTIVSKGGHAAYSVCDVTQEADSKRLIDTAVGTFGGVDVLICNAGVSMRALFDEVDLSVLHKLMDVNFWGCVNCTKYALPHIQKAHGSIVGVSSVAGIHGLPGRTGYSASKYAMTGFLETIRIENLRKGVHVMIACPGFTASNVRFSALTADGSQQGETPREEGKMMTAEEVARIIARGIVRRKRLCLMEFQGRATHFVKKFWPSLLDRMFYWYMSKEPDSPFK

SEQ ID NO: 1042 - protein, 255 aa, Artificial Sequence
  Synthetic
MAKQRIIAITGASGGLAQEIVKQLSLSDGIILLGRDKDKLEKCYRHVKNKTCLAIDLRDDNAIKEMVDYLYQRFGRIDVFINNAGFGEFKSYDNYTSQEVRDMFDINTLATMTFSRLIAEKMVEQGYGHIINIASMAGKIATANSSVYAATKFAVIGFSDALRIELADKGVYVTTVNPGPIETSFFDQADPSGAYLESVKKFILSPKYVAKKIVRILGKNKREVNLPRLLAVAYKGYTLFPTIADYLARTSFNYK

SEQ ID NO: 1043 - protein, 248 aa, Artificial Sequence
  Synthetic
MKLLEGKVAVITGAARGIGKAIALQFAKEGANIAFTDLVIDENGKATEAEIAALGVKAKGYASNAANFEETHKVIDEIVKEFGRIDILVNNAGITKDGLMMRMSEAQWDAVLTVNLKSAFNFIHAVVPVMARQRSGSIINMSSVVGVSGNAGQCNYSASKAGMIGLAKSIAKEMGPRGIRANCIAPGFIITDMTNQLSDEVKENWCKQIPLRRGGTPEDVAKVALFLASDLSSYVSGQVIHCCGAMNC

SEQ ID NO: 1044 - protein, 242 aa, Artificial Sequence
  Synthetic
MLKGKTAVITGASRGIGAAVAVKLAARGADIAVIYAGNVEAANQVRKECIEQYGVKAVAYKCNVADFSQVRETVAQIKKDFGTVHILINNAGITKDGLLAMMSEEAFDSVIDTNLKGAFNMIRHCTGMFIKNRQGCIVNVSSVSGLMGNAGQCNYSASKAGIIGLTKSVAKELAPRGIRCNAVAPGFIETDMTGSQKDNPLLGMIPLGRMGAAPEVAEAVAYLVEAEYVTGEVLRVDGGIAM

SEQ ID NO: 1045 - protein, 270 aa, Artificial Sequence
  Synthetic
MNFKDKTIVITGASSGIGYALAYEFASRGARIVMGARSEDKLRSIAEDLAARGTQAVYEPTDVTREEDCRRLVEKAVSSFGQIDVLICNAGISMRALFDEVDLGVLKRLMDVNFWGTVYCTKYALPYIQASRGSIVGVSSVAGFHGLPGRTGYSASKYAMTGFLETVRIENLKKGVHVMIAAPGFTASNVRFSALTADGSAQGESPRKEEKMMSAAEVARRIARGVVRRKRTLAMDFNGRATVLIKKFAPGLLDRLYYSHMAKEPDSPLK

SEQ ID NO: 1046 - protein, 255 aa, Artificial Sequence
  Synthetic
MTKNVLITGATSGIGEATARAFAKEGENVILTGRRVERLEALKEELQATYPGQKVWIFALDVTDMEMVKDVCQAILKSVGQVHVLVNNAGLALGLTAYQDYEEWDLLTMLDTNVKGLMMVTRQILPSMVAANEGHIINMGSTAGIYAYAGAAVYSATKAAVKTFSDGLRIDTIASDIKVTTIQPGIVETDFSQVRFHGDKDKAAKVYQGLEALQAQDIADAVLYVTKQPRRVQISDMTIMANQQATGFTIHRGDK

SEQ ID NO: 1047 - protein, 248 aa, Artificial Sequence
  Synthetic
MNKVVLITGGAKGIGKAIALELAKNQYDIVINYLTSDKEAKCLKEQIIRQYHVRCLTFKADVSKEDQVEKMIQEIDKQLGGVDILINNAGIDLSNLFHLKTADEFRKTLDVNVVGAFNCSKCVSSHMLDQDYGRIINISSTNGMNTYYPMCIDYDASKAALISLTHNLAFEFGPYIHVNCIAPGFIGTENELDGYDEEFLKQEQEKIMVKRYGKPEEVAYLVKFLISDEANFINNSIIRIDGGQIGSM

SEQ ID NO: 1048 - protein, 242 aa, Artificial Sequence
  Synthetic
MLKGKTAVVTGGSRGIGEAIAYKLASMGANVAVIYAGNASAAETVCEKCRQEYSVEAKAYLCNVADFSAAKETTAKIKADFGSAQILVNNAGITRDGLLALMKEEDFDAVLATNLKGAFNMIRHMTGLFIRAREGAIVNITSVAGMMGNAGQCNYSASKAGLIGLTKSVAKELAPKGIRCNAVAPGFIETDMTGNQAANPLLNLIPLGKMGKPDDVADAVAYLVTANYVTGEVLRVDGGIAM

SEQ ID NO: 1049 - protein, 270 aa, Artificial Sequence
  Synthetic
MDYKKVILITGASSGFGKVMATTLSRQGHIVYGTSRKTTDKQDKINTLAMDVTQPESILRTINTVISEQGRIDVLINNAGMGISGATELATEEEIKLQMDTNFLGVVRMCSAVLPYMRKERNGKIINISSLGGVIAVPFQGFYCASKFAIEGYSEALAQEVRSFNIKICLVEPGDFNTNFTANRAVSHITIQDKDYKEKFERTMKIIEKAERQGCNPEKLGRVISKLVKSKCPPFRTKVGPFEQIMFAKCLGILPNRLIQYLLHCFYKVY

SEQ ID NO: 1050 - protein, 255 aa, Artificial Sequence
  Synthetic
MELGLNGKVVVVTGGATGIGLETARAFLQEGCKVAICGRRMEKLQKAKEFLGSERVFVYQADMTDLEQVETFAAAVAKEYGSIDVWINNAGAMWIKPLLEMSSEEFRREIDLNLTTVFHGAKAAYPYMKAQGSGVILNASSFAALDPNAGRATYSAAKAAVKNLSASMAAEFAAANIRVLAYVPGMIATEIAAESIEKYGDALLADIPCRRFGTPEDLGKVLVFLASDAAGYMNGCHVEISGGKRCVQNPQFSYQ

SEQ ID NO: 1051 - protein, 248 aa, Artificial Sequence
  Synthetic
MLLENKIAIVTGGTRGIGLATVEAFLREGATVILTGSRQETADKAVAALKEKDPNTKVAGIAPNLADLASVEAAFQKVAQEYGRIDILVNNAGMSDSTPFDKYDEATFEKVMDLNVKGVFTCARAVTPIMQAQSSGVILNTSSMVSRYGQPSGIAYPTSKFAVNGFTLSLARELGKYGIRVNAVAPGITDTDMMRAVPEHIIKALCTQIPLGRIGKPEEVANAFVFLASEMASYITGVVLSVDGLART

SEQ ID NO: 1052 - protein, 242 aa, Artificial Sequence
  Synthetic
LVKQRRMPLPKRGKCHPNRSPCGALRSLERRAPSHLIQAQKVWTFTLDVTDMEMVKDVCQAILKSVGQVHVLVNNAGLALGLTAYQDYEEWDLLTMLDTNVKGLMMVTRQILPSMVAANEGHIINMGSTAGIYAYAGAAVYSATKAAVKTFSDGLRIDTIATDIKVTTIQPGIVETDFSQVRFHGDKEDKAAKVYQGLEALQAQDIAEAVLYVTKQPRRVQISDMTIMANQQATGFTIHRGE

SEQ ID NO: 1053 - protein, 270 aa, Artificial Sequence
  Synthetic
MMLSDKDFRLDGKVALVTGASYGIGFAIASAYANMGATIVFNDRNQESVDKGLAAYSNVGIKAHGYVCDVTDEEAVNHFVKQVEDEVGVIDILVNNAGIIKRIPMLEMSAADFRQVVDIDLNGPFIVSKAVIPGMMKKDHGKIINICSVMSELGRETVSAYAAAKGGLKMLTRNICSEYGEYNIQCNGIGPGYIATPQTAPLREKQTDGSRHPFDQFIVSKTPAARWGETDDLMGPAVFLASDASNFVNGHILYVDGGILAYIGKQPKGE

SEQ ID NO: 1054 - protein, 255 aa, Artificial Sequence
  Synthetic
MSKNVLITGATSGIGEATARAFAKEGENLILTGRRVERLQALKEELQATYPNQKIWTFALDVTDMEMVKDVCQAILKSVGQVHVLVNNAGLALGLTAYQDCEEWDMLTMLDTNVKGLMMVTRQILPSMVAANEGHIINMGSTAGIYAYAGAAVYSATKAAVKNFSDGLRIDTIATDIKVTTIQPGIVETDFSQVRFHGDKDKAAKVYQGLEALQAQDIADAVLYVTKQPRRVQISDMTIMANQQATGFTIHREED

SEQ ID NO: 1055 - protein, 248 aa, Artificial Sequence
  Synthetic
MIVLVTGATAGFGECITRRFIENGHKVIATGRRQERLQELKDELGDNLFIARLDVRNRASIEDMLASLPAEWRNIDVLVNNAGLALGLEPAHKASVEDWETMIDTNNKGLIYMTRAVLPGMVERNRGHIINIGSTAGSWPYAGGNVYGATKAFVRQFSLNLRTDLHGTAVRVTDIEPGLVGGTEFSNVRFKGDDDKAGKTYENTTALTPDDVTEAVWWVANLPAHVNINTLEMMPVTQSFAGLSVHRG

SEQ ID NO: 1056 - protein, 242 aa, Artificial Sequence
  Synthetic
MLKGKTAVVTGGSRGIGEAIVYKLASMGANVAVIYAGNATAAERVCEKCKQEYGVEAKSYQCNVADFSAAKETVAIIKADFGTAQILVNNAGITRDGLLAMMKEEDFDAVLDTNLKGAFNMIRHMTGLFIRAHGGAIINVTSVAGLMGNAGQCNYSASKAGLIGLTKSVAKELAPKGVRCNAVAPGFIATDMTGNQTDNPLLNMIPLGKMGETEDVADAVAYLATAKYVTGEILRVDGGIAM

SEQ ID NO: 1057 - protein, 270 aa, Artificial Sequence
  Synthetic
MAETFNMNKFSLTGKVALVTGASYGIGFAIASGYASAGATIIFNDINQDLVNKGLAAYQAAGITAYGYVCDVTNEIAVNEMVKKIEQEVGAIDILVNNAGIIKRIPMCEMSASDFRKVIDVDLNAPFIVSKAVIPSMIKKGHGKIINICSMMSELGRETVSAYAAAKGGLKMLTRNIASEYGEFNIQCNGIGPGYIATPQTAPLRELQADGSRHPFDQFIISKTPAARWGKTDDLIGPAIFLASDASDFVNGHVLYVDGGILAYIGKQPQ

SEQ ID NO: 1058 - protein, 255 aa, Artificial Sequence
  Synthetic
MNDIMNLFSLNGKSAVVTGANTGLGQGICVALAAAGAHVFGVARRSCDETAAKIAAEGGQFTEVRADLSDFASIDSILEQVHAHADRIDILVNNAGIIKRCDAIDVTPENWDAVDFLNEKMVFFLSQAVAKQWVADKKGGKIINIASMLSFQGGIRVPAYTSSKSAVMGMTKALANEWAKYGINVNAIAPGYMATNNTNQLRQDEDRSEEILARIPAGRWGTPADVGGAAIFLASDAAAYVNGYTLAVDGGWLAR

SEQ ID NO: 1059 - protein, 248 aa, Artificial Sequence
  Synthetic
MIVLVTGATAGFGECITRRFIENGHKVIATGRRQERLQELKDELGNNLYIAQLDVRNRASIEEMLDALPAEWRNIDILVNNAGLALGLEPAHKANVDDWETMIDTNNKGLIYMTRAVLPGMVERNRGHIINIGSTAGSWPYAGGNVYGATKAFVRQFSLNLRTDLHGTAIRVTDIEPGLVGGTEFSNVRFKGDDDKAGKTYENTTALTPQDVTEAVWWVASLPAHVNINTLEMMPVTQSFAGLSVHRS

SEQ ID NO: 1060 - protein, 242 aa, Artificial Sequence
  Synthetic
MRKTVLVTGSSRGIGRAVALKFASCGYRVVINCARSADRMEEVKKEVEALGAECLAVQADVGNPEDCKRLFQKIGSRFGHVDVLVNNAGISIIGLLQDLSFEDWNRIVSANLSSVFHCAKLAIPGMIHNHSGKIINISSVWGVCGASCEAAYSATKGGVNGLTMALAKELAPSGIQVNAIACGAIDTEMNRFLSEEEHEMLLDEIPAGRMGKPEEVADLVMKLVEAPDYLTGQVIKMDGGWI

SEQ ID NO: 1061 - protein, 270 aa, Artificial Sequence
  Synthetic
MRKTVLITGASRGIGRAIAVAFAKADYNLVITCSRSESELLSLKDELETVYSVDVLASIGDISDYEYVVRLFAHGKERFHGVDVLINNAGISYIGLIEDMTIEEWNRIVGVNLTSVFSTSKLAIPYMLSKKAGKIINISSVWSNVGASCEVAYSACKGGMNSFTRGLAKELAPSNIQVNAIACGCIDPQMNRCFLKKNVPPLPMRSHPDDLVHRKKWLPLLYLSLKEMNTLPDRSSHWMESGSDRILLLKQRSSSFLSKGCFSVFTILHV

SEQ ID NO: 1062 - protein, 255 aa, Artificial Sequence
  Synthetic
MAKQRIIAITGASGGLAQEIVKQLSPSDGIILLGRDKDKLEKCYRHVENKTCLAIDLRDDKAIKEMVDYLYQRFGRIDVFINNAGFGEFKSYDNYTSQEVRDMFDINTFATLTFSRLMAEKMVEKGHGHIVNIASMAGKIATANSSVYAATKFAVIGFSDALRLELSDKGVYVTTVNPGPIETSFFDQADPSGAYLESVKKFVLSPKYVAKKIVRILGKNKREVNLPRLLSFAHKGYTLFPKMADYLARTSFNYK

SEQ ID NO: 1063 - protein, 248 aa, Artificial Sequence
  Synthetic
MKLLEGKVALVTGAARGIGKAIALRFAEQGADVAFTDLVINEAAEQTVAELQAYGVKAKGYASNAASFEESHAVVKQIMEDFGRIDILVNNAGITKDGLMMRMSEAQWDAVINVNLKSAFNFIHAVVPIMARQRGGSIINMSSVVGVSGNAGQCNYSASKAGMIGLAKSIAKEMGPRGIRANCIAPGFIITDMTNQLSQEVRDAWIAQIPLRRGGTPEDVANVALFLASDLSSYVSGQVIHCCGAMNC

SEQ ID NO: 1064 - protein, 241 aa, Artificial Sequence
  Synthetic
MKKVILVTGASRGIGNNIARSLAHENIVIANYNKSKDEAKKLKADLKSENIDIDIIKADVSNRTEVKEMIEGIITKYGKIDVLINNAGISQYKLFTDITDEDWENIMNINLKSNFIVTQEVVENMIANKNGLIINISSIWGVTGAAMEVAYSTSKAGIIGLTKSLAKELGPSNIRVNAIAPGIIDTSMNNKFSEEEINDIKEEIPLERVGKPEEITKCIEWLLEDNYTTGQVISINGGWNI

SEQ ID NO: 1065 - protein, 270 aa, Artificial Sequence
  Synthetic
MQELTKGEMYLRTKKVAVITGATRGIGNAVALQLAKDGYAIVGCGTMDPARAEGHMKEIADTSPEFLYVQADVSREEDRRNLIDRTLERFGRIDVLVNNAGVGSLVRTNILDVTEESLDRVFGINLKGYLFLGQLAAKQMIKQVEAGDPAPKPVIINMSSISAYTLSVMRGEYCMSKAAIAMLTKLLAFALADYGINVYEIRPGNILSDMTLPVKEHFDKLIADGLHPLRRWGTGEDCAKAVSAICKGYLPYTTGSAIDVDGGFHMKWID

SEQ ID NO: 1066 - protein, 255 aa, Artificial Sequence
  Synthetic
MANRFEGKSVVVTGASSGMGREIALEFAAEGATVVAVARRMERLEELAAQAEGLSGTILPYPGDISSVEVNNGMIDYAVEKCGKLDILVNNAGIMDEFKPIAEVTDEQWERVMKVNLDGPMFAMRRAVEVMLGHGTAGSIVNVASIGGIRGARAGAAYTASKHALVGLTKNTAYMYAPNNIRCNVVCPGGVETEVMDSQSDLSQVGMGRVMAGLDTSIPAGQSRDIATAVLYVASDDARFMTGSTIVVDGGVSCN

SEQ ID NO: 1067 - protein, 248 aa, Artificial Sequence
  Synthetic
MDFSGKNVWVTGAGKGIGYATALAFVEAGAKVTGFDRVFAQEQYPFATEVMDVADAGQVAQVCQRLLAETERLDVLVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEELRIRGFGEQFKLGIPLGKIARPQEIANTILFLASDLASHITLQDIVVDGGSTLGA

SEQ ID NO: 1068 - protein, 242 aa, Artificial Sequence
  Synthetic
MGKLSGKTAIITGASAGFGRRTAYAFAKEGCNLILTARREERLQEAAEKCRALGAQAIYYAGDAREEKTAIETVRLAIETFGKVDILINNAGIGRVLSLTDTSMEEYDLIMNSNVRSAFAFTKHTVPDMITRGDGQIILVSSVTGIRGHADETAYTCSKFALRGFGQALDRELLSKGIKTCVFCPHAGVTEFEIGYGRDADEWAKTGFLTPDDVGQALLSVCTQTSNAHIAELRLAANNCVY

SEQ ID NO: 1069 - protein, 270 aa, Artificial Sequence
  Synthetic
MAIILITGASSGIGYQTAELLAQNGHKVYGAARRMDKLEKLKSVGVEPIYLDITNEESCRKLVDTIIDNEGQIDILINNAGYGSYGAIEDVPLEEAKRQFEVNLFGLAALTKLVLPHMRHQKAGRIINISSMGGRFTTYFGAWYHATKYALEAFSDALRMEVKPFGIDVSLIEPGGIKTNWGLIAADHLAESAKGGTYEEAALKTATGMRKQYSGNMMSDPKIISKTISKAVSSKRMRARYLIGFGAKPLVFLHTILPTRIFDWLIMRAS

SEQ ID NO: 1070 - protein, 255 aa, Artificial Sequence
  Synthetic
MRKKRIVIKMDFTNKTVLVTGSSRGIGKAIAFAFGQAGARVVLNASRSKDQLEEAKKELEEMGVSCMAVLADVSDYNACKDMFLQIQDAFGPVDILVNNAGISHIGLFTDMTPEQWQHVLNVNLGSVLNCTHLAVPAMVHNKTGVILNISSMWGEAGASCEAVYSASKGGINAFTKAMAKELGPSGIRVNAIACGVIDTEMNACFSEEERAELAEEIALMRFGKPEEVGRFALTLASESASFLTGQIITLDGGML

SEQ ID NO: 1071 - protein, 248 aa, Artificial Sequence
  Synthetic
MSIKGKVVVITGASSGIGAATAKLLAAKGAKVVLGARREERLQALSQAIGDNAVYQVTDVTDRQQVRALIDLAVSKFGRVDVLYNNAGTMPQGNLSDREYDKWQMMLNVNIMGVLNGIGEVLPIMQKQHDGLIIATDSVAGHVVYPASAVYNGTKYAVRAIMEGLRQEEKEHGIRSTIVSPGAVRTELVNTIGNTQIQAGISELMNADDRQGLALNPEDIANAVLFAIDQPKHVAISEVLVRPAQQEV

SEQ ID NO: 1072 - protein, 242 aa, Artificial Sequence
  Synthetic
MSEKKVALITGASQGIGKVTALKLASCGYDIAINYIGREDDAKEVKKECEAFGVEAEIFEFDVTNVEAVNAGVEAIHKRFGRIDVLVNNAGITKDGLFLRMTPDQWNAVININLTGAYNVTHPVVKIMMKQRIGSIINMSSIVGVMGNAGQANYSASKAGLIGFTKSLAKELGSRNIRVNAVAPGFIKTAMTEGLDNNEIYQHIPLRRMGEAEDIATVIKFLAEDATYVTGQVIGVDGGLVV

SEQ ID NO: 1073 - protein, 270 aa, Artificial Sequence
  Synthetic
MTSSMTFETMFSLKGRVALVTGAAYGIGFAIARALAKAGAKVAFNCRSRQHLEMALEEYRKEGVDARGYIADVTEETQVKDLIAKIERDLGTIDILVNNAGIIKRIPMTEMSVEEYRQVVDIDLVAPFIVAKAVLPGMIRQGHGKIINICSMMSELGRETVSAYAAAKGGLKMLTRNICAEYGGANIQCNGIGPGYIATPQTAPLREIQPDGSRHPFDQFILAKTPAARWGTPEDLEGPAIFLASDASDFVNGHILYVDGGILAYIGKQP

SEQ ID NO: 1074 - protein, 255 aa, Artificial Sequence
  Synthetic
MAKQRIIAITGASGGLAQDIVKQLSPSDGIILLGRDKDKLEKCYRHVENKTCLAIDLRDDNAIKEMVDYLYQRFGRIDVFINNAGFGEFKSYDCYTSQEVRDMFDINTFATMTFSRLMAEKMVEQGHGHIINIASMAGKIATANSSVYAATKFAVIGFSDALRLELADKGVYVTTVNPGPIETSFFDQADPSGAYLESVKKFVLSPKYVAKKIVRILGKNKREVNLPRLLAVAHKGYTLFPRISDKLATNIFNYK

SEQ ID NO: 1075 - protein, 248 aa, Artificial Sequence
  Synthetic
MNFSGKNVWVTGAGKGIGYATALAFVEAGAKVTGFDRAFTLEHYPFATEVLDVADAGQVAQVCQRLLGETQRLDVLVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 1076 - protein, 242 aa, Artificial Sequence
  Synthetic
MIQKNVFITGGDKGIGKAIALRLAAQYCNVIITYNRNKKGACELSERFSNLSYYQCNLEDRANIEEVSEKVLDRYAQIDILVNNAGYEDDATFLKMEHEQWERVLNINLGSIFYFAHAFLPSMVAAGWGRIVNFTSIAGYTGAFGKSNYAAAKAGIVGFTKSLSLEFGSKGICTNAVAPGAIETDMLMRIPERHRVKILENIPSHKFGKVEDVANLVEFLISDKASYINGQTIHINGGSFGI

SEQ ID NO: 1077 - protein, 270 aa, Artificial Sequence
  Synthetic
MKTILITGASNGIGKETALLFADRGWNVAATMRSKEKLSMFTDSKNIKTYLLNVKNKESIRSCIKQVICDFGKIDVVVNNAGIYTTTPLEMTSDDVIEDIIETNIKGILSVTKTILEHFRENKSGMIVNISSIAGRATFPYQSVYHTSKWAVEGFSESLYYELEPLGIRVKVVEPGVVKTNLYESLSDSKFEKYPKEYQDNFVKRYDSQLENLKNGYSPILDAKTIYRAVNSKSSKLRYTTDSTTKMALFLNRLLPLSLFRSMIKKMNQQ

SEQ ID NO: 1078 - protein, 255 aa, Artificial Sequence
  Synthetic
MEYDYLKIAGKPAIVTGGGRGIGRATALALGRFGAKVMICDVHDDWGESAVKEIRDHGGVAEYRHCDVADPEQVKALVAATVEVFGDVDILVNNAGIGSVSLPFEEITDEDWDRMLRVDLTAPFYLCREVIPYMKARKHGKIINISSGSGIIGCEFCSHYASAKAGLIGFTQSIAKELGGDHINANAIAVPTTQTPMLKETDFDIFVEDELRDIPWGRIGTPEDIADMVLYLASDASEYVTGQVLAPNGGRRTPV

SEQ ID NO: 1079 - protein, 248 aa, Artificial Sequence
  Synthetic
MELTYKNKIALVSGAGRGIGKAIAEALAKGGCTVICVSKNMSSCGKVAEEINASGGKAEAFAADLSNPSEVKSLCETVLKKYEAVDILVNNAGITKDNLLMRMSDEEWNAVMDTNLSSCFHMCRGLIRAMMGKRSGRIVNITSVTALAGNAGQCNYAAAKAGIIGFTKTLAREVAARNITVNAIAPGFIDTDMTAVLPESIMENLKNAIPLKHTGKPEDIAAACAFLASDQAGYITGQVLSVNGGLYM

SEQ ID NO: 1080 - protein, 242 aa, Artificial Sequence
  Synthetic
MNKIIIVTGASKGIGREIAKQLAIKGNTIIANYNKSEKEILELKKELEEKNIKIEIFKADVSKREEASKLVDYAIEKYKKIDVLINNAGISQIKEFTQITDEDWNNMINTNLNSVFYMSQEACKNMIHNKKGCIINISSIWGITGASCEVHYSVSKAGVDALTKALAKELGPSNIRVNSIAPGIINTEMNSHLNKDEIEGLKEEIPLERIGKTQDIERCVEWLIEDEYTTGQVISINGGWNI

SEQ ID NO: 1081 - protein, 269 aa, Artificial Sequence
  Synthetic
MSVCTPKSFDLTGKVALITGASYGIGFAIATAMANCGAKIVFNDIKQELVDKGLAAYKEAGIEAHGYVCDVTNEDAVNAMVKQITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGQYNIQCNGIGPGYIATPQTAPLREIQPDGSRHPFDQFIVAKTPAGRWGNAEDLGGPAVFLASEASDFVNGLILYVDGGILAYIGKQPG

SEQ ID NO: 1082 - protein, 255 aa, Artificial Sequence
  Synthetic
MTALFDLTGKTALVTGSARGLGFAYAEGLAAAGARVILNDIRDTLLAESVDTLTSKGYDAHGVAFDVTDEQAIEAAFSKLDAEGISVDILINNAGIQYRKPMVELELENWQKVIDTNLTSAFLVSRAAAKRMIARNSGGKIINIGSLTSQAARPTVAPYTAAKGGIKMLTCSMAAEWAQFNIQTNAIGPGYILTDMNTALIEDKQFDSWVKSSNPSQRWGRPEELIGTAVFLSSKASDYINGQIIYVDGGWLAVL

SEQ ID NO: 1083 - protein, 248 aa, Artificial Sequence
  Synthetic
MNKVVLVTGGAQGIGKAIVLELAKNHYDVVINYLTSSEAATLLEEEIKKNYDVRVMTVQADVSKEEEVDAMISLIEKEWGGVDILINNAAVDLSNLFHLKTADEFRKTLDVNVVGAFNCSKRVYRHMLDQEYGRIINISSTNGINTYYPMCIDYDASKAALISLTHNLAFEYGPYINVNAIAPGFIGTDNELDGYDEEFLKEEQEKIMVNRYGKPEEVAYLVKFLISDEANFINNTIIRIDGGQKGSC

SEQ ID NO: 1084 - protein, 242 aa, Artificial Sequence
  Synthetic
MIKKDVKVNILVTGASKGIGRAIALNLLKSANVYVTGRNAEALKSIKAKGYIAGDITKETDVNAIAKFIQEKEIDVLINNAGEYIYKDIDKINYYEVVKLFSVNLLSPILLISKAVPHMKEKRWGRIINIGSISGVMGEAHASLYSSSKAGLLGLTKALALELAEYNITVNTINPGWVDTDLGNESVEESEFSKEELIDCIPQRRFVQPEEVAGLCKYLISEEAKGITGQGINLCAGLSVGI

SEQ ID NO: 1085 - protein, 269 aa, Artificial Sequence
  Synthetic
MSVCTPKSFDLTGKVALITGASYGIGFAIATAMANCGAKIVFNDIKQELVDKGLAAYKEAGIEAHGYVCDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGEAEDLGGPAVFLASEASDFVNGLILYVDGGILAYIGKQPG

SEQ ID NO: 1086 - protein, 255 aa, Artificial Sequence
  Synthetic
MAKQRIIAITGASGGLAQEIVKQLSPSDGIILLGRDKDKLEKCYRHVENKTCLAIDLRDDNAIKKMVDYLYQRFGRIDVFINNAGFGEFKSYDNYTSQEVRDMFDINTFATMTFSRLMAEKMVEQDHGHIINIASMAGKIATANSSVYAATKFAVIGFSDALRLELADKGVYVTTVNPGPIRTTFFDQADPEGTYVKAVDRYILEPDYVAKKIVKNFGKPKRELNLPRLLNVAHKLYTLFPRISDKLATNMFNYK

SEQ ID NO: 1087 - protein, 248 aa, Artificial Sequence
  Synthetic
MKLLEGKTALITGAARGIGKAIALKFASEGANIAFTDLVIDENGKQTEEEIAAYGVKAKGYASNAADFNQTKEVVAKVKEDFGSIDILVNNAGITKDGLMMRMSEQQWDAVINVNLKSAFNFINAVLPIMLRQRSGSIINMASVVGVHGNAGQANYAASKAGLIALAKSIAQEVGSRGIRANAIAPGFIETAMTAALPDDIRAEWTKKIPLRRGGKVEDIANVATFLASDMSSYVSGQVIQVDGGMNM

SEQ ID NO: 1088 - protein, 242 aa, Artificial Sequence
  Synthetic
MSEKKVALITGASQGIGKVTALKLASCGYDIAINYIGREDDAKEVKKECEAFGVQAEIFEFDVTNVEAVNAGVAAIVEKFGRIDVLVNNAGITKDGLFLRMTPDQWNAVININLTGAYNVTAPVVKIMMKQRIGSIINMSSIVGVMGNAGQANYSASKAGLIGFTKSLAKELGSRNIRVNAVAPGFIKTAMTEGLDNNEIYQHIPLRRMGEAEDIATVIKFLAEDATYVTGQVIGVDGGLVV

SEQ ID NO: 1089 - protein, 269 aa, Artificial Sequence
  Synthetic
MSVCTPKSFDLTGKVALITGASYGIGFAIATAMANCGATIVFNDIKQELVDKGLAAYKEAGITAHGYVCDVTNEDAVNAMVKQITEEVGHINILVNNAGIIKRIPMCEMTAAQFRQVIDVDLNAPFIVAKAIIPDMIEQGGGKIINICSMMSELGRETVSAYAAAKGGLKMLTKNIASEYGQYNIQCNGIGPGYIATPQTAPLREIQPDGSRHPFDQFIVAKTPAARWGNAEDLGGPAVFLASEASDFVNGLILYVDGGILAYIGKQPG

SEQ ID NO: 1090 - protein, 255 aa, Artificial Sequence
  Synthetic
MKKTAIITGASRGIGYAAAKKLGMDGCQVVLFATGEKERYKAAIDGLTQAGITWHYVRGSLDCREDRERLIRETVEKFGRIDILVNNAGVAPKERKDLLEMSEESFDRVLGINTKGTMFLTQLAAKQMIKQEQIFKSKGHIVNVGSCSAEVSSTSRGEYCVSKAAVSMLTTLFADRLAPEGILVNEVRPGVIATDMTSVVTEKYDTMIKNGVFPIARWGKAEDVAEMIAFFCSDSVLYTTGNYVDVDGGFHIKRL

SEQ ID NO: 1091 - protein, 248 aa, Artificial Sequence
  Synthetic
LVTGAAGGLGRAFVAELIKEELDEIWSIGRNREKLARLKEFFGDKIIPVCKDLTDTKQLKSVSVLLEEEKADVRYLVNNAGIARMAPSEDFSPEEIERTIDLNCKAPVLLMNYCLPFLSKGSKILNISSASAFQPTPYINLYAATKAFERSYSRALNAELKARGITVTAVCPSWVDTDLLTKEIKGVKVKFHGIVSPGRVAAKALKDAKKGKDMSVCSLYVKCQHLNVKLMPQKLTMKLWLNSIKKYL

SEQ ID NO: 1092 - protein, 242 aa, Artificial Sequence
  Synthetic
MAKVALITGATRGIGKAIALKLASSGFNIALNYRKENDDLIATKNEIEKLGVECLPVQGDISSFEDCERMTKEIIAKYEEINVLVNNAGITKDMLLMRMKPDDFKCVIDVNLVGTFNMTRNVIPYMIKAREGRIVNISSVVGVNGNAGQTNYASSKAGVIGFTKSLARELGSRNILVNAVAPGFIETDMTAVLNDTVRDEIAKKISLKRMGSAEDVAGVVDFLCGDSSRYVTGTVIPVDGGI

SEQ ID NO: 1093 - protein, 269 aa, Artificial Sequence
  Synthetic
MSVCTPKSFDLTGKVALITGASYGIGFAIATAMANCGATIVFNDIKQELVDKGLAAYKEAGIEAHGYVCDVTNEDAVNEMVKKITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGEAEDLGGPAVFLASEASDFVNGLILYVDGGILAYIGKQPG

SEQ ID NO: 1094 - protein, 255 aa, Artificial Sequence
  Synthetic
MAKQRIIAITGASGGLAQEIVKQLSLSDGIILLGRDKDKLEKCYRHVENKTCLAIDLRDDNAIKEMVDYLYQRFGRIDVFINNAGFGEFKSYDHYTSQEVRDMFDINTFATMTFSRLMAEKMVEQGHGHIINIASMAGKIATANSSVYAATKFAVIGFSDALRLELADKGVYVTTVNPGPIETSFFDQADPSGAYLESVKKFVLSPKYVAKKIVRILGKNKREVNLPRLLAVAHKGYTLFPKIADYLARTSFNYK

SEQ ID NO: 1095 - protein, 248 aa, Artificial Sequence
  Synthetic
MESETLYNEKRKQALITGASRGIGAGIAIALAKEGYDLILVCRKSMERLNALQKEVELTYGVKCEAYQCDVSDPEEVEKLFSICGEVDVLINNAAISYVGLLTDMSVLEWQQVINTNLNALFYTSRQVLPGMIHRKSGKIINVSSVWGAVGASMEVAYSAAKGGVNAFTRALAKEVAPSHIQVNAIAFGVIDTEMNDCFTEEEKQALIEEIPADRMGTAQEAGELVVKLLESPDYLTGQVITMDGGWI

SEQ ID NO: 1096 - protein, 242 aa, Artificial Sequence
  Synthetic
MKKTVLVTGSSRGIGRAVALKFASCGYHVVINCARSTERMEEVKKEVEALGAECLAVQADVGNPDDCKRLFKEIESRFDHVDVLVNNAGISIIGLLQDLSFEDWNRILSANLSSVFHCAKLTIPGMIHNHSGKIINISSVWGVCGASCEAAYSATKGGVNGLTMALAKELAPSGIQVNAIACGAIDTEMNGFLSDEEHEMLLDEIPAGRMGKPEEVADLVMKLVEAPDYLTGQIIKMDGGWI

SEQ ID NO: 1097 - protein, 269 aa, Artificial Sequence
  Synthetic
MSVCTPKSFDLTGKVALITGASYGIGFAIATAMANCGATIVFNDIKQELVDKGLAAYKEAGIEAHGYVCDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGKAEDLGGPAVFLASEASDFVNGLILYVDGGILAYIGKQPG

SEQ ID NO: 1098 - protein, 255 aa, Artificial Sequence
  Synthetic
MKKIALVTGSRRGIGLGIAEALGKEGYFVVLSAATPADEEVTARLTAEGIGCTYISCDISKTEDRRRLLDTVIERYGRLDVLVNNAGVAPKVRLGILETTEESFDRLMNINLKGTFFMCQAAANRMIELQKKSLEDYRPRIVNISSMSAYTSSVNRGEYCISKAGISMTTQLFADRLAEYGIPVFEVRPGIIMTDMTAGVHEKYQKLIDEGVTPIRRFGLPEDVANCVLAAVSGRLDFATGQILNADGGFHIRRL

SEQ ID NO: 1099 - protein, 248 aa, Artificial Sequence
  Synthetic
MMSELLKDKVCIVTGAAQGIGKSIALKMIEDGAIVYGCDRLADSMRDMELEYERFHALYFDVTDTQASKESMMRVKKEQGRIDALVNNAGVVFNKKIGMILRSETELMFRVNVIAVIEMVQLVSRLMARNGGGSIVNIASVTAVLGSSGQSAYSATKGAIMSFTKSAAKELADQGIRVNAVAPGIVKTERFSELYEESGEKIDIRIQKIALGRLGTPEDVANACAFLVSDRSSYISGQILGVDGCASI

SEQ ID NO: 1100 - protein, 242 aa, Artificial Sequence
  Synthetic
MRNVLITGSARGIGAQTAKLFAAEGYNVIVNYNTSEKEAAETCREIRLGGGNSVMIQADVSKRSEAERLFAEAKREFGTIDTLVNNAGIAQIKLFTDVTDDDYDRMFDCNVRSVFNCCQLALPDMIHNKFGRIINVSSMWGIAGASCEVIYSASKSAIIGFTKALAREVAPSGITVNAVAPGVIDTPMNGGFDRETVNTLVEETPVGRLGTPEDVARAIFFLADEKSGFITAQTLGIDGGFI

SEQ ID NO: 1101 - protein, 269 aa, Artificial Sequence
  Synthetic
MKIAIVTGASSGMGRETAVQLADRFAGFGEIWLVARREERLSQLEEILPVPVRKFAIDLTDREQLAELETALQNEQPDVKILVNASGYGKMGRVGSVSTEEETGMVRLNCEALCAVTHMVLPYMSKNSRIIQYASSASFLPQPGFAIYAATKSFVLSYSLALGEELKGRGICVTAVCPGPVKTEFFDIAETTGRIPLYKRLTMADPVKVVKLAIRDSLMGKPVSVYGFLMKSFRLLCKTVPHGVILKIMSRISGKQVESPVNAVIDKTP

SEQ ID NO: 1102 - protein, 255 aa, Artificial Sequence
  Synthetic
MSILNTFDLTGKTAIVTGGGRGLGKGIAEGLCEAGASVVIIGSSNSVINTAKEFTDKGFIAYAIKGDLSNKELIPTIFNEALSKLNGKIDILINNAGIQRRHKCEEFPLSDWETVLQVNLNTVFMLCQLAGNVMLKQGHGKIINLASMLSFFGGYTVPAYAASKGAVAQLTKALANEWANKNINVNAIAPGYMNTEMNVNLVNDTNRNQEILNRIPAGRWGTPNDMKGLAIFLSSSASNYINGAIIPVDGGYLSR

SEQ ID NO: 1103 - protein, 248 aa, Artificial Sequence
  Synthetic
MKLLEGKTALITGAARGIGKAIALKFAEEGANIAFTDLVIDENGKATEAEIAAKGVKAKGYASNAADFAQTAEVVNQVKEDFGSIDILVNNAGITKDGLMMRMTEAQWDAVINVNLKSAFNFIHACTPIMMRQKSGSIINMASVVGVHGNAGQCNYAASKAGLIALAKSIGQEIGSRGIRANAIAPGFIETAMTQALPDNIRKEWIQKIPLRRAGQTEDIANVAVFLASDLSSYVTGQVIQVDGGMNM

SEQ ID NO: 1104 - protein, 242 aa, Artificial Sequence
  Synthetic
MPVVLITGASRGIGRATAFAFARDCWCVAVNYCHSEKQGLEVVEAIRDFGGLACAVPGDVTDPQACQAMVRQTVDTFGPLDALVNNAGISLPGQFQDVSPAMFAQCLATNLEGPRNMIAAALPGMLERKRGAIVNVSSMWGVSGASCESAYSASKAGLIGLSKALARELGPCNIRVNCVAPGVIETDMNRNLSPADYQALADQTPLCRIGQPEEVASAILFLAGPGASFITGQVLGVDGGFI

SEQ ID NO: 1105 - protein, 269 aa, Artificial Sequence
  Synthetic
MSVCTPKSFDLTGKVALITGASYGIGFAIATAMANCGATIVFNDIKQELVDKGLAAYKEVGINAHGYVCDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATTQTAPLREIQPDGSRHPFDQFIVAKTPAERWGEAEDLGGPAVFLASEASDFVNGLILYVDGGILAYIGKQPG

SEQ ID NO: 1106 - protein, 255 aa, Artificial Sequence
  Synthetic
MNNMGLLTGKTALVTGAARGIGKAVAMKFAQEGANIAFTDLVLNDDMAAGLEATRKEIEALGVTCRAYAGNAADFEETEKVVKQIHADFGSIDVLVNNAGITKDGLMLRMSEAQWDAVLNVNLKSAFNFIHACSPIMLRQRSGSIINMASVVGVHGNAGQCNYAASKAGMIALAKSIAQELGPKGIRANAVAPGFIETAMTAALSEDIRKDWMKKIPLRRGGQPEDIANVCAFLASDMSSYVSGQVIQIDGGMNM

SEQ ID NO: 1107 - protein, 248 aa, Artificial Sequence
  Synthetic
MIILVTGATAGFGEAITRRFVKNGHKVIATGRRQARLDALKDELGESVLTLQLDVRNRAAIEEAISSLPLEWRDIDVLVNNAGLALGLEPAHKASVEDWENMIDTNNKGLVYMTRAVLPGMVERNRGHVINIGSTAGSWPYAGGNVYGATKAFVRQFSLNLRTDLHGTAVRVTDIEPGLVGGTEFSNVRFKGDDDKAGKTYENTTALTPDDVTEAVWWVATLPPHVNINTVEMMPVSQSFAGLSVHRQ

SEQ ID NO: 1108 - protein, 242 aa, Artificial Sequence
  Synthetic
MKKQVLVTGANKGIGYEIARHLGKSGWQVVVGARCEDRALKAMEALRTDGADVAGWQYVNLADNGEIEVSAREIAEKYPGLSLLVNNAGIPGDMSVRSYEQSLQDVIDTVQVNYIGTFYLTKLLLPLLEKNQGRICNITVPSTFSPYWHPMAYVASKAGQNTMIATMGWEFDHFHVPVEAFTIHPGATSTDLNGHYDGPGSHQPDVIGQKVAEIINDGKRHNGEFIELYPIVDEGNYVTIQQ

SEQ ID NO: 1109 - protein, 269 aa, Artificial Sequence
  Synthetic
MRNKVVIVTGASSGIGKALVYGFAAEGCKIAMGARNIEKLLLIEQELRAQGVEIISVRTDVSVEADCKQLIDQTYQQFGRIDILVNNAGISMRAVFEELDMKVLHRLLDVNFWGTVYCSKYALPHLLNSRGSLVGIISIAGFIGLPGRSGYAASKFAMRGFLNTLRIENLKKGLHVLVAAPGFTASNIRTTALDASGRQQGESPRDEAGMMSAEKCASLIIKGIRKRKREIIMTFVEGKLTVFLDKWWPRLIDKLAYSHMAKEPNSPFK

SEQ ID NO: 1110 - protein, 255 aa, Artificial Sequence
  Synthetic
MNDIMNLFSLNGKNAVVTGANTGLGQGICVALAAAGAHVFGVARRSCDETAAKIAAEGGQFTEVRADLSDFSAIDSILEQIHAHADRIDILVNNAGIIKRCDAIDVTPENWDAVDFLNEKMVFFLSQAVAKQWVADKKGGKIINIASMLSFQGGIRVPAYTSSKSAVMGMTKALANEWAKYGINVNAIAPGYMATNNTNQLRQDEERSEEILARIPAGRWGTPADVGGAAIFLASDAAAYVNGYTLAVDGGWLAR

SEQ ID NO: 1111 - protein, 248 aa, Artificial Sequence
  Synthetic
MGLLTGKTAIITGAARGIGKAIALKFASEGANIAFTDLVIDENGQNTEKEIAAFGVKVKAYASNAASFEDTAKVVEQIKEEFGSIDILVNNAGITKDGLMMRMGEAQWDAVIAVNLKSAFNFIHACTPIMMRQKSGNIINMASVVGVHGNAGQCNYSASKAGMIGLAKSIAQELGSRGIRANAIAPGFIITEMTAQLSDDVKAEWYKRIPLRRGGTPEDVANTALFLASDLSSYISGQVIQIDGGMNM

SEQ ID NO: 1112 - protein, 242 aa, Artificial Sequence
  Synthetic
MTERKVALVTGASRGIGKSCALELAKAGYDIAVNFAGNEEAANKTVEEIKALGVDAAAFKFDVSKQEDAAKGVEAVLEKFGRIDVLVNNAGITRDGLFMRMSAENWDAVINTNLSSAFYVSQPVVKVMMKQRSGAIINMSSVVGVSGNAGQANYSAAKAGLIGLTKTLAKELGSRGIRVNAIAPGFINTDMTKDLDTSKFTDFIPLKRLGEPEDIAKAVKFLAADSDYITGQVLEVDGGLII

SEQ ID NO: 1113 - protein, 269 aa, Artificial Sequence
  Synthetic
MSVCTPKSFDLTGKVALITGASYGIGFAIATAMANCGATIVFNDIKQELVDKGLAAYKEAGIEAHGYVCDVTNEDAVNAMVKQITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGQYNIQCNGIGPGYIATPQTAPLREIQPDGSRHPFDQFIVAKTPAARWGNAEDLGGPAVFLASEASDFVNGLILYVDGGILAYIGKQPG

SEQ ID NO: 1114 - protein, 255 aa, Artificial Sequence
  Synthetic
MAKQRIIAITGASGGLAQEIVKQLSPSDGIILLGRDKDKLEKCYRHVENKTCLAIDLRDDKAIKEMVDYLYQRFGRIDVFINNAGYGEFKSYDNYTSQEVRDMFDINTFATLTFSRLMAEKMVEQGNGHIVNIASMAGKIATANSSVYAATKFAVIGFSDALRLELADKGVYVTTVNPGPIETGFFDQADPSGVYLESVKKFVLSPKYVAKKIVRILGKNKREVNLPRLLSVAHKGYTLFPRISDKLATNVFNYK

SEQ ID NO: 1115 - protein, 248 aa, Artificial Sequence
  Synthetic
MKLLEGKTALITGAARGIGRAIALRFAQEGANIAFTDLVIDETGKATESEIAALGVKCKGYASNAADFQQTKEVVAEVVKDFGRIDILVNNAGITKDGLMMRMTEQQWDAVINVNLKSAFNFINAVLPVMLRQRGGSIINMASVVGVHGNAGQANYAASKAGLIALAKSIAQEVGSRGIRANAIAPGFIETAMTAALPEEVRAEWTKKIPLRRGGKPEDIADVATFLASDMSSYVSGQVIQVDGGMNM

SEQ ID NO: 1116 - protein, 242 aa, Artificial Sequence
  Synthetic
MGDKKLALITGGSRGIGKACAKEFAKAGFDVAIVYAGNEAAANETVQELKEMGSDASAYKFDISNEDSVTAGVNAVIEKYGRIDVLVNNAGITRDGLFVRMGSEDWNAVINTNLSGAYYVSKPVVKLMMKQRSGSIINISSIVGVMGNAGQANYSAAKAGLIGYTKSLAKELGARNIRVNAIAPGFVKTDMTKGLDSEKMSEHIPLKRLGEAEDIAVTAKFLAVDGTYITGQVIGVDGGLVI

SEQ ID NO: 1117 - protein, 269 aa, Artificial Sequence
  Synthetic
MEKNFLQNFSLEGKVALVTGASYGIGFGIATAFAQCGATIVFNDIKQELVDKGLAAYKEKGIEAHGYVCDVTDEAAVNALVARIEKEVGVIDILVNNAGIIKRIPMTEMSAAEFRQVIDVDLNAPFIVSKAVIPGMIKKGHGKIINICSMMSELGRETVSAYAAAKGGLKMLTRNICSEYGEYNIQCNGIGPGYIATPQTAPLRERQPDGSRHPFDSFIVAKTPAARWGTPEDLQGPAVFLASDASNFVNGLVLYVDGGILAYIGKQPK

SEQ ID NO: 1118 - protein, 255 aa, Artificial Sequence
  Synthetic
MAKQRIIAITGASGGLAQEIVKQLSPSDGIILLGRDKDKLEKCYRHVENKTCLAIDLRDDSAIKEMVDYLYQRFGRIDVFINNAGFGEFKSYDNYTSQEVRDMFDINTLATMTFSRLMAEKMVEQGHGHIINIASMAGKIATANSSVYAATKFAVIGFSDALRLELADKGVYVTTVNPGPIETSFFDQADPSGAYLESVKKFVLSPKYVAKKIVRILGKNKREVNLPRLLAVAHKGYTLFPRISDKLATNVFNYK

SEQ ID NO: 1119 - protein, 248 aa, Artificial Sequence
  Synthetic
MNDIRKVAFVTGASRGLGRAIVEKLASDGFKVGFSYVSSDEKAKSIVDELTARGLEVFSVKFDVKNFQEVENAFDKIYEEHGRIDVLVNNAGITRDKLFSRMKEDDFDQVIDTNLKGIFNCSKQVARKMSKQKSGRIINISSLAGLVGNIGQVNYSASKAGVIGFTRSLAAELGAYGITVNAVAPGLIKTDMTDAIPDQIREGMIKAIPLKRIGQPEDIGNIVGFLAGDAGSYITGQVISVDGGLSSI

SEQ ID NO: 1120 - protein, 242 aa, Artificial Sequence
  Synthetic
MKKTIVITGASRGIGRAIAIELAGKDTNIVINCAKNVDKLNEVKAVIEKKGSVCETFVGDMGNFEDVQKMFDICLQRFGQVDILVNNAGISIVGLFQDMNESEWNKICNTNIGSVFNCCHFAVKDMMKRHCGKIINISSVWGLYGASCEVAYSATKGAVNAFTRALAKELAPSGIQVNAVACGAIDTEMNGHLSEDDKASLAEEIPAGRFGSPQEVAELVKSLTGMNSYLTGQIITLDGGWI

SEQ ID NO: 1121 - protein, 269 aa, Artificial Sequence
  Synthetic
MDLSAFNLQGKVALITGGAHGIGFSIAEGMAKCGAVICFNCSSEASLEKGMAAYKAAGIDAHGYVADVSNEDAVNAMVAKIKAEVGSVDILVNNAGLMKRVPMIEMSHADFMRVIDVHVGGAFNCSKAVLPDMMEKRAGKIINICSMMSELGRETVSAYAAAKGALKMLTKNIASEYGEYNIQCNGMGPGYIATAQTAPLRERQPDGSRHPFDQFIVAKTPAGRWGDPEDMVGPCVFLASHASDFVNGQILYADGGILAYIGRQPKSKS

SEQ ID NO: 1122 - protein, 255 aa, Artificial Sequence
  Synthetic
MKGKLIFITGATSGIGEGCARKFAAMGSNLILNGRNTAKLEALKQELTAQGVEVLILPFDVRDREAMRQTVDSLEGKWRNIDVLINNAGLVIGMDKEHEGSLDEWDIVIDTNIKALLAMTRMIVPGMVERGCGHIINIGSIAGDAAYAGGSVYCATKAAVKALSDGLRIDLVDTPLRVTNIKPGMVETNFSVIRFRGDKDKADAVYEGIKPLTGDDIADVVYYAASAPAHIQIAEVLVMPTYQATGTVCHRRKND

SEQ ID NO: 1123 - protein, 248 aa, Artificial Sequence
  Synthetic
VNKDTVKGKNILITGATSGIGKTIARQFAGEGARVVLVGRRQEILQKLKEELGENTITAACDLSKTDDINKIFQICKENQCKLNGLVHCAGIAGLSGVRAFDSEEAMNMMQVNTFSFVELCKRFASKRNSYDESGIVAISSISSILNDPGMILYSMSKSALNSAVKTMSKEFMKRKIRVNGILPANVKTQMFLGGEDTLEDFMERSLERQPLGIIDTEQVSYLAEFLLSDNAKYITGECIVMSGGMTY

SEQ ID NO: 1124 - protein, 242 aa, Artificial Sequence
  Synthetic
VSASVLITGASGGIGQALARAFAQKGWGVGIHCHRGEEAARALTEELRRQGARAFCYQADVSQEDQVGAMFAQAREDLGFLEVLVNNAGISWRGLLTDMTLSQWERVFAVNVTGAFLCCREALPEMIRQKRGCIVNISSMWGQQGASCEAAYSASKAALIGLTQALAREEGPSGVRVNCVAPGVIDTPMNGALSQEDLDALREETPLERVGSPEEVAQAVLSLVENPFITGQTLGVNGGFVI

SEQ ID NO: 1125 - protein, 269 aa, Artificial Sequence
  Synthetic
MQPQIILITGASSGFGKITAQMLSEQGHIVYGTSRKPSGNMNNVKMLVADVTNILSIHEAVGQIISEQGRIDVLINNAGMGIGGALELATEDEISGQMNTNFFGVVNMCKVVLPYMCKARRGKIINISSIGGVMGIPYQGFYSASKFAVEGYSEALALEVHPFHIKVCIVEPGDFNTGFTDNRNISEATRVNTDYKESFLKSLEIIEKEERNGCHPKKLGHAICKIVARKNPPFRTKVGPWIQVTFAKSKKWLPDVVMQYALRIFYAIQ

SEQ ID NO: 1126 - protein, 255 aa, Artificial Sequence
  Synthetic
MELKNKNVFVTGSTRGIGLAVAHKFASLGANVVLNGRSEISEDLLAQFADYGVTVVGISGDISNGEDAKRMVAEAIEKLGSVDVLVNNAGLALGLAPAYEAEVADWLTMIQTNIVGLTYLTRKILPQMVERNDGYIINLGSTAGTVPYPGANVYGASKAFVKQFSLNLRADLAGKKIRVSNIEPGLCEGTEFSSVRFKGDEKRVEALYRDAHAIQPEDIANTVAWLIQQPKHVNVNRIEIMPVSQTFGPQPVYRD

SEQ ID NO: 1127 - protein, 248 aa, Artificial Sequence
  Synthetic
MIILVTGATAGFGECITRRFVANGHKVIATGRRQERLQELKEELGDNILTAQLDVRNRAAIEEMIANLPAQWRAIDVLVNNAGLALGMEPAHKASVEDWENMIDTNNKGLVYMTRAVLPGMVERNRGHIINIGSTAGSWPYAGGNVYGATKAFVRQFSLNLRTDLHGTAIRVTDIEPGLVGGTEFSNVRFKGDDAKADKTYENANALTPEDVTEAVWWVATLPNHVNINTVEMMPVSQSFAGLNVHRG

SEQ ID NO: 1128 - protein, 241 aa, Artificial Sequence
  Synthetic
MGKVALITGASCGIGRQMARDFAAQGYGVAIGYLRHEQEALALQAELGPSALAVQADLADTEAIAAMVQKVTAHFGNIDVLINNAGIASFGLLTEISEKDWLRLFDINVHGAYRCIREVLPKMISRGRGVILNISSIWGVTGASCEVCYSATKAALIGLTKALAKEVGPSGVRVNCIAPGVIETDMNAHLSAEDLSALAEETPLGRIGTPEDVSAAALFLASPGASFITGQVLGANGGIVI

SEQ ID NO: 1129 - protein, 269 aa, Artificial Sequence
  Synthetic
MSVCTPKSFDLTGKVALITGASYGIGFAIATAMANCGATIAFNDIKQELVDKGLAAYKEAGIEAHGYVCDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGEAEDLGGPAVFLASEASDFVNGLILYVDGGILAYIGKQPG

SEQ ID NO: 1130 - protein, 255 aa, Artificial Sequence
  Synthetic
MNNMGLLSGKTALVTGAARGIGKAVAMKFASEGANIAFTDLVLNDDMAAGLEATRKEIEALGVTCRAYAGNAADFEETEKTVKQVQADFGSIDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTAQLPEDIRKDWMKKIPLRRGGQTEDIANVCLFLASDMSSYVSGQVIQIDGGMNM

SEQ ID NO: 1131 - protein, 248 aa, Artificial Sequence
  Synthetic
MQTNQKVAFVTGGTRGIGRAIVEKLAQEGYIVGFSYVSSDEKANAMVEELKAKGQNVFAMKFDVKDSEKVAEAFDKIYEEYENIDVLVNNAGITRDKLFIKMKEADFDDVIDTNLKGIFNCTKQVARKMTKKRSGRIISLSSLAGLVGNVGQTNYSASKAGVIGMTRTLAAELGPYSITVNAIAPGFIQTDMTDAIPEKIKAKIVDAIPLRSVGQPKDIADTVAFLAGESARYITGQVISVDGGLSSI

SEQ ID NO: 1132 - protein, 241 aa, Artificial Sequence
  Synthetic
MNRLEGKIAVVTGSARGIGRAIVEKLAAHGAKMVVSCDMGETSYEQKNVIHKILNVTDREAIKTFVDEVEKEYGKIDILVNNAGITKDGLLMRMTEDQWDAVINVNLKGVFNMTQAVSRSMLKARKGSIITLSSVVGLHGNAGQTNYAATKGGVIAMSKCWAKEFGGRNVRANCVAPGFVQTPMTDVLPEETVKGMLAATPLGRLGQVDDIANAVLFLASDESSFITGSNICIWWFNALIS

SEQ ID NO: 1133 - protein, 269 aa, Artificial Sequence
  Synthetic
MDLGLKGKSVVVTGGSKGIGFAAAEAFLKEGAKVAICSRHEEELKEAAEKLSQYGEVYYEAFDVSKAESNYAFAEHVNDRFGSVDVWVNNVGATGFKKGDEYDDEEIDFMTGVCFKSVIYGCQAAFRYMKKQHSGAIVNVSSLAARCSSAGRSTLYGPLKSAINNLTNTFAGEYCPYNVRVTCIMPGFTVTPLVRAHISQEELDRNANATLLRRMAEPEEIAKPIVFLASDAASYMTATTIEVSGGRSMTLNPTYAYDKLAAEKAEAAK

SEQ ID NO: 1134 - protein, 255 aa, Artificial Sequence
  Synthetic
MAATETTASAGARRVALVTGGSRGIGRAICLELARAGMDIAVVYAGNEEAAQATVAAVEELGQAARAYRCDVASAEEVDATVKQVIADFGGVWALVNNAGVTRDTLLARMKEDDFERVIDVNLKGAYHLVRALTRQFMRQRGGRIINMSSVVGLMGNAGQVNYAASKAGLIGLTKSVARELAGRNVTVNAVAPGFVETDMTAALPEAARTAYEQQIPLGRLASPEEIAALVGFLASDAAAYITGEVIRCDGGMAM

SEQ ID NO: 1135 - protein, 248 aa, Artificial Sequence
  Synthetic
MGLLTGKTAIVTGAARGIGKAIALKFAAEGANIAFTDLVIDENGQNTEKEIAALGVKVKGYASNAANFEDTEKVVNQIKDDFGSIDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITDMTAKLSEEVKAEWAKKIPLRRGGTPEDVADVATFLASDMSSYVSGQVIQVDGGMNM

SEQ ID NO: 1136 - protein, 241 aa, Artificial Sequence
  Synthetic
MSEKLALVTGASRGIGKACAVELAKAGYDIAVNYAGNVEAANKTVEELKALGVNAEAFKFDVSSQEAAAKGVEEVLAKFGRIDVLVNNAGITRDGLFMRMSAENWDAVINTNLSSAFYVSQPVVKVMMKQRSGAIVNMSSVVGVSGNAGQANYSAAKAGLIGLTKTLAKELGSRGIRVNAIAPGFINTDMTKDLDTSKFTDFIPLKRLGEPEDIAKAVKFLAVDAEYVTGQVLEVDGGLII

SEQ ID NO: 1137 - protein, 269 aa, Artificial Sequence
  Synthetic
MSVCTPKSFDLTGKVALITGASYGIGFAIATAMANCGATIVFNDIKQELVDKGLAAYKEAGITAHGYVCDVTNEDAVNAMVKQITEEVGHINILVNNAGIIKRIPMCEMTAAQFRQVIDVDLNAPFIVSKAVIPDMIAQGGGKIINICSMMSELGRETVSAYAAAKGGLKMLTKNIASEYGEYNIQCNGIGPGYIATPQTAPLRERQPDGSRHPFDSFIVAKTPAGRWGEAEDLGGPAVFLASAASDFVNGLILYVDGGILAYIGKQPQ

SEQ ID NO: 1138 - protein, 255 aa, Artificial Sequence
  Synthetic
MAKQRIIAITGASGGLSQEIVKQLSPSDGIILLGRDKDKLEKCYRHVENKTCLAIDLRDDKAIKKMVDYLYQRFGRIDVFINNAGYGEFKSYDNYTSQEVRDMFDINTFATMTFSRLMAEKMVEQGNGHIVNIASMAGKIATANSSVYAATKFAVIGFSDALRLELADKGVYVTTVNPGPIETSFFNQADPSGAYLESVKKFVLSPKYVAKKIVRILGKNKREVNLPRLLAVAHKGYTLFPRISDKLATNVFNYK

SEQ ID NO: 1139 - protein, 248 aa, Artificial Sequence
  Synthetic
MKLLEEKVALITGASRGIGKAIALEFAKYGCNIAFSDMRRDENMENCEKELAAMGVKAKGFASDASSFEGSAQLVDEVVKEFGRIDILVNNAGITRDNLLMRMSESDWDLVINVNLKSVFNLTHACQKVMLKQRSGSIINMSSVVGVSGNAGQANYSASKAGIIGFTKSVAKELGSRNIRCNAIAPGFIITDMTAKLSEEVRKEWEQKIPLRRGGKPEEVAKACVFLASDLSSYVSGQVIHVCGAMNC

SEQ ID NO: 1140 - protein, 241 aa, Artificial Sequence
  Synthetic
MKTALITGATGSIGAATVRALAAAGYAVAIGYRRSDAAALTEEIRKAGGTAGMYFLDVTDTASVNTAIESVTADLGHIDLLVNNAGVAASGLLTELTDPEWEKIISTNLSGVFRCCRAVLPGMIRRSSGCILNISSIWGITGAACETAYSAAKAGIIGLTRALAKEVGPSGIRVNCIAPGVVDTPMNAHLSPADLAALAAETPLGRIGRPEEIAAAVCFLAGTGGEFLTGQVISPNGGLVI

SEQ ID NO: 1141 - protein, 269 aa, Artificial Sequence
  Synthetic
MAQCTPKSFDLTGKVALITGASYGIGMAIAKAMAANGATIVFNDIKQELVDKGLAAYEEAGIKAHGYVCDVTDEDAVNALVAKITEEVGHINILVNNAGIIKRIPMTEMSAAQFRQVIDVDLNAPFIVAKAVIPDMIAQGGGKIINICSMMSELGRETVSAYAAAKGGLKMLTKNIASEYGKYNIQCNGIGPGYIATPQTAPLREIQPDGSRHPFDQFIVAKTPAGRWGEAEDLGGPAVFLASAASDFVNGLILYVDGGILAYIGKQPQ

SEQ ID NO: 1142 - protein, 255 aa, Artificial Sequence
  Synthetic
MEKAVFAADALAGRVVLVTGASRGIGAGILEAFVKAGATVVGSATSEAGAEKITARIAELGGQGRGVVLNVNDTDAGQKSVADIVEAYGRIDVLVNNAGITRDTLAMRMKDEQWDDVIDTDLSAAFRFARACLRPMMKQRSGRIISITSVVGAMGNPGQVNYAAAKAGLMGMTKALAREIGSRGITVNCVAPGFIDTDMTRVLSDEQKDHLQAQIPLGRLGSVDDIAQSCLFLASDAGAYITGVTLHVNGGMYMG

SEQ ID NO: 1143 - protein, 248 aa, Artificial Sequence
  Synthetic
MKLTYTDKTALVSGAGRGIGREIALELAQAGCAVICVSRNESSCGAVAEEICKAGGKAESFAFDVSDAAQTKEKCAEILKKYGAVDILVNNAGITRDNLLMRMTDEEWNDVISTNLSSCFYLSRNLVRAMMGKRWGRIINITSVSGIAGNAGQANYSAAKAGIIGFTKTLARELAARNITSNAVAPGFIETDMTAKLPENIVEAAKAAIPLKTFGKPADIARVCAFLASEEASYITGQIISVNGGLVI

SEQ ID NO: 1144 - protein, 241 aa, Artificial Sequence
  Synthetic
MNILLTGTSRGLGLAICEKLLERGDTIYAVSRTKSDDIIKLEQKFSRNLLFKAADLSEPEIARSKIFAPDFVSASVRLDGFVSNAASAYDDIATNMNLARLENMFQTNLFSPMILTKYFLRHSLLHSNGGSIVYISSVSAHTGYKGLSMYAASKGALEAFSKNIAREWGIKSVRSNVVSPGFMSTQMSAKLTAQQREKIYARTSLKAETSADSVAETVAFLLSEKAKSITGQTICVDAGTI

SEQ ID NO: 1145 - protein, 269 aa, Artificial Sequence
  Synthetic
MDTGAYLHSVFGLEGKTILVTGAAGGIGSAISRGLASAGGEVALCGRNLEKCRILADEIAAAGGKASAHHLDVADLDSIQGCVDEVVQQYGKIDVLFNVAGINKREGLLDVAPETYDRIMNTNLKGLFFISQAVAREMYRQKSGNIINIGSHNDTGMLGGCSVYGAAKSGVVALTRSMAVEFAQYGIRCNAISPGHILTELTQVTWDHPTRGDYLRERIAMGRPGSPEELVGMAIMLASDASSYMTGQAYHVDGGCLCGGSPWEYDTQY

SEQ ID NO: 1146 - protein, 255 aa, Artificial Sequence
  Synthetic
MNKMGLLSGKTALVTGAARGIGKAVAMKFASEGANIAFTDLVLNDEMAAGLEATRKEIEALGVTCRAYAGNAADFEETEKTVKQIHADFGSIDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTAQLPEEIRKDWMKKIPLRRGGQTEDIANVCLFLASDMSSYVSGQVIQIDGGMNM

SEQ ID NO: 1147 - protein, 248 aa, Artificial Sequence
  Synthetic
MKLLEGKTALITGAARGIGKALALRFAQNGANIAFTDLVIDENAEQTKREIEELGVKCAAYASNAADFAQTAEVVDKIKVDFGHIDILVNNAGITKDGLMLRMTEGQWDAVINVNLKSAFNFIHAVLPLMMRQRKGSIINMASVVGVHGNAGQANYAASKAGLIALAKSIAQEVGSRGIRANAIAPGFIITEMTNALPEEVKQGWYQQIPLRRGGTPEDVAKVALFLASDLSSYVSGQVIHCCGAMNC

SEQ ID NO: 1148 - protein, 241 aa, Artificial Sequence
  Synthetic
MSEKLALVTGASRGIGKACAIELAKAGYDIAVNFAGNEEAANKTVDEIKALGVDAAAFKFDVSNQEAAAKGVEAVLEKFGRIDILVNNAGITRDGLFMRMSAENWDAVINTNLSSAFYVSQPVVKVMMKQRSGAIINMSSVVGVSGNAGQANYSAAKAGLIGLTKTLAKELGSRGIRVNAIAPGFINTDMTKDLDTSKFTDFIPLKRLGEPEDIAKAVKFLAADSDYITGQVLEVDGGLII

SEQ ID NO: 1149 - protein, 269 aa, Artificial Sequence; identical to SEQ ID NO: 1097
  Synthetic

SEQ ID NO: 1150 - protein, 255 aa, Artificial Sequence
  Synthetic
MQKIAVVTGGSRGIGFGIASQLAEDGFHVVIMAVSPREKHKEHLLLLENYPSGYTYIQGSIASREDRIRCISQVIREYGRIDVLVNNAGIAPQKRTDLLDMTEESFDELIQTNTKGTMFLSQLAAKQMLCQEAVNGIRGIIINISSMSAVVSSVNRGEYCVSKAGISMLTRLYADRLAGEQIYVYEVRPGIIATDMTSVVREKYDSLFKQGICPIARWGNPEDIGNAVSILCSGKLKYSTGQVIDVDGGFHIQRL

SEQ ID NO: 1151 - protein, 248 aa, Artificial Sequence
  Synthetic
MKLLEGKVAIVTGAARGIGKAIALKFAAEGANIAFTDLVIDENGEATQKEIEALGVKAKGYASNAANFEDTHNVVAEIQKDFGRIDILVNNAGITKDGLMMRMSEGQWDAVLNVNLKSAFNFIHACTPIMMKQRAGNIINMSSVVGVHGNAGQSNYSASKAGMIGLAKSVAQELGSRGIRANAIAPGFIITDMTAKLPEEVREEWNKKIPLRRGGSTEDVANVATFLASDLSAYVSGQVIQVDGGMNM

SEQ ID NO: 1152 - protein, 241 aa, Artificial Sequence
  Synthetic
MSEKLALVTGASRGIGKACAIELAKAGYDIAVNFAGNEEAANKTVEELKGLGVDAAAFKFDVSDKEAAAKGVEEVLAKFGRIDVLVNNAGITRDGLFMRMSAENWDAVINTNLSSAFYVSQPVVKVMMKQRSGAIVNMSSVVGVSGNAGQANYSAAKAGLIGLTKTLAKELGSRGIRVNAIAPGFINTDMTKDLDTSKFTDFIPLKRLGEPEDIAKAVKFLAVDADYVTGQVLEVDGGLII

SEQ ID NO: 1153 - protein, 269 aa, Artificial Sequence
  Synthetic
MQPQVILITGASSGFGKITAQMLSERGHIVYGTSRKPSEDMNQVKMLVVDVTNSFSVCQAVERILLEQGRIDVLINNAGMGIGGALELATEDEISGQMNTNFFGVVNMCKVVLPYMRKARRGKIINISSIGGVMGIPYQGFYSASKFAVEGYSEALALEVHPFHIKVCIVEPGDFNTGFTDNRNISEATRVNTDYKESFLKSLEIIEKEERNGCHPKKLGHAICKIVACKNPPFRTKVGPWIQVTFAKSKKWLPDVVMQYALRIFYAIQ

SEQ ID NO: 1154 - protein, 255 aa, Artificial Sequence
  Synthetic
MARQRIIAITGASGGLAQEIVKHLSPSDGIILLGRDKDKLEKCYRHVENKTCLAIDIRDDNAIKELVDYLYQRFGRIDVFINNAGFGEFKSYDNYTSQEVRDMFDINTFATMTFSRLMAEKMVEQGHGHIINIASMAGKIATANSSVYAATKFAVIGFSDALRLELADKGVYVTTVNPGPIETSFFDQADPSGAYLESVKKFVLSPKYVAKKIVRILGKNKREVNLPRLLSVAHKGYTLFPKMADYLARTRFNYK

SEQ ID NO: 1155 - protein, 248 aa, Artificial Sequence
  Synthetic
MKLLEGKTALITGASRGIGRGIAEIFAKHGANVAFTYLSSVEKGQALEAELSSHGVKAKGYRSDASDYDQAQALAEEVAKDFGRIDILVNNAGITRDGLLMRMGKDQWDAVIKTNLDSVFNLTKAVQRTMLKQRSGSIINMSSVVGIKGNAGQANYAASKAGIIGFTKSVALELGSRGIRCNAIAPGFIETEMTGALDPKVVEGWTEAIPLKRAGTVEDIANACLFLGSDLSTYVTGQVLSVNGGMLT

SEQ ID NO: 1156 - protein, 241 aa, Artificial Sequence
  Synthetic
MSENLALVTGGSRGIGKACALHLAQAGYNVVINYAGNEEAANKTVSELEALGVKAEAVKFDISNHDEAQEAVAKIIEKYGRIDVLVNNAGITRDGLFMRMSKENWDAVINTNLTGAFNVTQPVIKVMMKQRSGAIVNMASIVGIYGNAGQANYAAAKAGLIGFTKSLAKELASRNIRVNAVAPGFVQTDMTKSLDSAQISEHIPLKRLGDADDIAGAVKFLAVDATYVTGQVLQVDGGLTI

SEQ ID NO: 1157 - protein, 269 aa, Artificial Sequence
  Synthetic
MSVCTPKSFDLTGKVALVTGASYGIGFAIATAMANCGAKIVFNDIKQELVDKGLAAYKEAGIEAHGYVCDVTNEDAVNEMVKKITAEVGHINVLVNNAGIIKRIPMIEMTAAQFRQVIDVDLNAPFIVAKAIIPDMIAQGGGKIINICSMMSELGRETVSAYAAAKGGLKMLTKNIASEYGAYNIQCNGIGPGYIATPQTAPLREIQPDGSRHPFDQFIVAKTPAGRWGEAEDLGGPAVFLASEASDFVNGLILYVDGGILAYIGKQPQ

SEQ ID NO: 1158 - protein, 255 aa, Artificial Sequence
  Synthetic
MFDLTDKVAVVTGASSGLGADSARAYAQNGANVVLLARRKEKLEQVAAEISGMGRKVLAISCDVTDEECVKKAVEEIIEKFGRIDILLNNAGVAVRGGVDTLTVEDWDHAMDVNVKGMFIMSKYIVPHMKEQNYGKIVNISSVNALIGDKADMFIRHSYNASKSAVLGLTIGMAASYGQFNITVNAVCPGLFESEMTKDTLFKSEAFLQGYSAQCPMSRPGKRGEVSGPVLFFSSDASSYVTGQHIVVDGGTSIV

SEQ ID NO: 1159 - protein, 248 aa, Artificial Sequence
  Synthetic
MRVKDKVIIVTGASRGIGYAVADKLLSEGAKLVACASNQKNADKAVLALKGSHPNAMILGLGVNNNESKEVEKAVKKVHETFGKIDVLINNAGITTDVSFFDMTEEEFVNVMNVNVNGIFRWCKAVAPIMKDNDGGSIINTSSMVATFGQKSGCSYAASKAAVNGLTKSLAKELGQYGIRVNAVAPGVTKTDMVAAIPDKFIDALAAMTPLGRVGTPKELAGAYVYLASDESTFTNGTIIGVDGGLVM

SEQ ID NO: 1160 - protein, 241 aa, Artificial Sequence
  Synthetic
MEILKGKIALITGASGGIGSCIARRFAQDGISLALLGRSEEKLAATAASVREYGVETLLLPGDLLDDAYLEDCFAAVKERFGGLDILVNNAGIALSRSFEETTMAEFDRIMALNARVPYLACHLALPLLRCSECASILNIASVVAHKGYPLQSAYAASKHALAGFTKSLASEVYREDIRVHLISPGGVFTDMVRIARPDLTGEDMILPEDIAEIAAFFIEHRTNAVIDEICVHRSGKEPFL

SEQ ID NO: 1161 - protein, 269 aa, Artificial Sequence
  Synthetic
MQSQVILITGASSGFGKFTAQMLSEQGHIVYGTSRKPSENMNNVKMLVVDVTSPLSIRQAVKQIISEQGQIDVLINNAGIGISGALELATEDEVSKQMNTNFFGVVNMCREVLPVMRKARKGKIINISSIGGVMGIPYQGFYSASKFAVEGYSEALALEVHPFNIKVCLVEPGDFNTGFTDNRNISELTRSDADYKESFLKSLGIIEKEERNGCHPRKLAAAICRIVARKNPPFRTKVGPLVQVLFAKSKRWLPDTVIHYALRIFYAIN

SEQ ID NO: 1162 - protein, 255 aa, Artificial Sequence
  Synthetic
MESFNPFSLEGRTIIITGASSGIGKQCAIDCSKMGAKIILIARNEERLKETLSLMNNRDNHAYYLADFTQLTNIADLIKEIVSANGKISGFIHAAGIELTKPLKLISIEDYEKIFRINTLSGFEFIHQFSNKKNFEDGGHIVLISSITSIIGRGGVAAYSASKGAMISAIRSMAIELSKKKICINCISPGTILTPLMANFLSTLSEEQYLKRVSGFPLGLEKCTDISNACIYLLSDASQWITGQNFIIDGGYTIL

SEQ ID NO: 1163 - protein, 248 aa, Artificial Sequence
  Synthetic
MMSELLKDKVCIVTGAAQGIGKSIALKMIEDGAIVYGCDRLEGSMSALELEFERFHALYFDVTHAQAAKESMMRVKKEQGHIDVLVNNAGVVFNKKIGMIVREETELMFRVNVIAVIELVQLVSRLMARNGGGSIVNIASVTAVLGSPGQSAYSATKGAIISFTKSAAKELAPIGVRVNAVAPGIVKTERFAELYEDSKEKIDMRIAKIALGRLGSPDDIANACSFLASDRSSYISGQILGVDGCASI

SEQ ID NO: 1164 - protein, 241 aa, Artificial Sequence
  Synthetic
MKTVIVTGASRGIGKSIALRFAKEKVQMAITCRHNTDMLNEVKDEILKLGSDCICYTGDLSLSDNVNDLFNIIEKTYGNVDILINNAGISYIGLINTMSDKDWHNVMGSNTDSMFYCCRAVIPYMLKKHSGRIINISSVWGNYGASCEAAYSASKGAVNTFTKALAKELAPSGISVNALACGLIDTDMNNCFTDEEKHDIIQDIPAGRMGTTEEIADAVYAISCFSPYITGQIITADGGWR

SEQ ID NO: 1165 - protein, 269 aa, Artificial Sequence
  Synthetic
MRDKVVIITGASSGIGKALAYELAHQGAKVVLAARNIEELLHIEQDLRQQGAEVLSVRTDVTKESACKELIEQAYARFGRIDALINNAGISMRALLEDLEPAVLRKVMDVNFWGTVYCSKYALPYLLESKGSLVGVISIAGFIGLPGRTGYAASKFAVRGFLNTVRIENMKKGLHVMVAAPGFTASNIRKTALNANGRQQGESPRNENKMMTAEKCAAIIVKGIRKRKREIIMTFVEGKLAVFLSKWLPGLVDRLSYSLMAKEPDSPFK

SEQ ID NO: 1166 - protein, 255 aa, Artificial Sequence
  Synthetic
MSISYDFAGKTVVVTGSARGIGRRIGERFYEAGANVAFCSISAGGKEELMQEVAGSDRSRIMAKSVDVSKPEQIEAFFQDVVVKFGALDVLVNNAGIFTSETVDTVTEADWARVMDTNLKSMVFTSQWFSRYHKEQGTGGNIVNIASVSSVTYIPHNLLYNISKAGVVTLTKTLARDLGPCGIRVNAVGPGSIPTDLNAALYADKQREIDLCNKIPLGRRGTKDDIANCVLFLASDESSYLTGQVIYAEGGWLLV

SEQ ID NO: 1167 - protein, 248 aa, Artificial Sequence
  Synthetic
MQKLAGKIAVVTGAGRGIGNAIARRLASEGAKVVLISRSPSSCGGAANEINKEFPGSCKAFPCDVSDYNAVQETASAILKEFPQIDILVNNAGITRDTLMLRMKEEDWDQVMDTNLKSAFNLVKAFQRILMKSSAGRIINMSSVIGLVGNVGQANYAASKAGLLGFTKSIAQEFAPRKVTCNVIAPGFISTEMSNAIPENLKEEILKKIPLREQGSVEDIAALTAFLASDDARYITGQVIACDGGMTM

SEQ ID NO: 1168 - protein, 241 aa, Artificial Sequence
  Synthetic
MNRIKTAVITGGSRGIGAECVRVFAENGYRVYFTYKSNEEKAKKISEETGAYAVKCDVSRAEDIDAFVLLMKDRGHESDVLINNAGISQIKLFTDISERDWDIIFDVNIKGMFLMTHALIGDMIRKKYGRIINISSMWGISGGSCEVHYSASKAAVIGFTKALAKEEGPSGICVNCIAPGVIETEMNAVLSMEDKAALCDETPLMRMGTPKEVADAALFLASENAGFITGQVISVDGGITV

SEQ ID NO: 1169 - protein, 269 aa, Artificial Sequence; identical to SEQ ID NO: 1117
  Synthetic

SEQ ID NO: 1170 - protein, 255 aa, Artificial Sequence
  Synthetic
MAKQRIIAITGASGGLAQEIVKQLSPSDGIILLGRDKDKLEKCYRHVENKTSLAIDLRDDKAIKEMVDYLYQRFGHIDVFINNAGFGEFKSYDNYTSQEVRDMFDINTFATMTFSRLMAEKMVQYGHGHIVNIASMAGKIATANSSVYAATKFAVIGFSDALRLELADKGVYVTTVNPGPIETSFFNQADPSGAYLESVKKFVLSPKYVAKKIVRILGKNKREVNLPRLLAVAHKGYMLFPHISDKLATNVFNYK

SEQ ID NO: 1171 - protein, 248 aa, Artificial Sequence
  Synthetic
MNKVVLVTGGAKGIGRAIALELAKQGYDIVINYLTSQKEAEALQKEIKEMYGVRCMAIPCDVSKEDEVDKMISCIEEKLGGVDILINNAAVDLSNLFHLKTAEEFRRTMEVNVVGAFNCSKRVYRYMLEKEYGRIINISSTNGINTYYPMCIDYDASKAALISLTHNLAFEFAPYIHVNCIAPGFIGTENELDGYDEEFLREEIEKIMVQRYGDPKEVAYLVKFLISEEADFINNTIIRIDGGQKGSC

SEQ ID NO: 1172 - protein, 241 aa, Artificial Sequence
  Synthetic
MKTVLITGGTRGIGRDIAFEFLQRGYEVIINYSSNESAAIATQAEFNMLGYCPVLMRADVSDEAQVRDMFSEIFRLYNKIDVLVNNAGISYVGVIQDTTPAEWDRVFGVNVKGAYLCSRAVADRMIGMGGGSIINISSIWGEVGASCEVAYSASKAALIGFTKALSKELAPSGVRVNCVSPGVIDTTMNSHLTPDEIEELIEQIPMGRLGTGEDVAKACIYLAESGYVTGEVLSVGGGFGK

SEQ ID NO: 1173 - protein, 269 aa, Artificial Sequence
  Synthetic
MQSQIILITGASSGFGKITSQMLSEQGHIVYGTSRKTSENMGKVKMLVVDVTNTSSIQQAIGQIISEQGRIDVLINNAGMGIGGALELAAEREVDIQMSTNFFGVVNMCKAVLPYMRKARKGKIINISSIGGVMGIPYQGFYSASKFAVEGYSEALALEVHPFNVKVCLVEPGDFNTGFTDNRNISELTRQDSDYGESFLNSLKIIEKEERNGCHPRKLGSSICKIVARKNPPFRTKVGPVVQVLFAMSKSWLPDRVMQYALRLFYAIK

SEQ ID NO: 1174 - protein, 255 aa, Artificial Sequence
  Synthetic
MSDLFNLQGKTAMVTGSARGLGFSYAQGLAAAGATVILNDIREALLEDSVKTLTAQGYCAHGLAFDVTDEEAIEKAFNTLDAQNIQVDIVINNAGIQYRKPMVELELEHWQKVIDTNLTSAFLVSRAAAKRMISRQSGGKIINIGSLTSQAARPTVAPYTAAKGGIKMLTCSMAAEWAQFNIQTNAIGPGYILTDMNTALIEDEKFDSWVKNSNPSQRWGHPQELIGTAVFLSSKASDYINGQIIYVDGGWLAVL

SEQ ID NO: 1175 - protein, 248 aa, Artificial Sequence
  Synthetic
MKLLEGKTALITGAARGIGKALAIKFAQEGANIAFTDLVIDENGKATEEEIAALGVKAKGYASNAADFNQTKEVVAEIHKDFGRIDILVNNAGITKDGLMMRMSEAQWDAVIAVNLKSAFNFINAVLPIMLRQRGGSIINMASVVGVHGNAGQSNYAASKAGLIALAKSIAQEVGSRGIRANAIAPGFIETAMTAALPDDVRAEWVKKIPLRRGGQTDDIANVATFLASDMSSYVTGQVIQVDGGMNM

SEQ ID NO: 1176 - protein, 241 aa, Artificial Sequence
  Synthetic
MKTALITGGTRGIGRAIAFEFLQRGYEVIINYCSNESAAIATQAEFNMLGYCPVLMRADVSDEAQVRDMFSEIFRLYNKIDVLVNNAGISYVGVIQDTTAAEWDKIFGVNVRGAFLCSRAVTDRMIGAGGGSIINISSIWGEVGASCEVAYSASKAALIGFTRALSKELAPSGVRVNCISPGVIDTSMNAHLTQEELEELIEQIPAGRIGTGEDVAKACAYLAEAQYVTGVVLPVGGGFAK

SEQ ID NO: 1177 - protein, 269 aa, Artificial Sequence
  Synthetic
MQSQIILITGASSGFGKFTAQMLSEQGHIVYGTSRKPSENMNNVKMLVVDVTSPLSIRQAVEQIISEQGRIDVLINNAGIGIGGALELATEDEVNKQMNTNFFGVVNMCREVLPLMRKARKGKIINISSIGGVMGIPYQGFYSASKFAVEGYSEALALEVHPFHIKVCLVEPGDFNTGFTDNRNISEQTRLNADYRESFLKSLEIIEKEERNGCHPRKLAAAICKIVARKNPSFRTKVGPLVQVLFAKSKRWLPDSVMQYALRIFYAIK

SEQ ID NO: 1178 - protein, 255 aa, Artificial Sequence
  Synthetic
MQRIAVVTGGSRGIGFGIASQLAEDGFHVVIMAVSPWEKHKERLHLLESYPSGYTYIQGNIASREDRSRCISQVIREYGRIDVLVNNAGIAPKKRADLLDMTEESFDELIQTNTKGTMFLSQLAAKQMLLQEPINGIRGIIINISSMSAVVSSVNRGEYCVSKAGISMLTRLYADRLAGEQIYVYEVRPGIIATDMTSVVREKYDGLFKQGICPIARWGNPEDIGNAVSILCSGKLKYTTGQVIDVDGGFHIQRL

SEQ ID NO: 1179 - protein, 248 aa, Artificial Sequence
  Synthetic
MKKTAFVTGATSGFGEAIARRLSKEGYKIVALARREDRLKKLAAELDDTHIIVADIRDKEAVFKAVESLPDKFKDIEVLVNNAGMALGLEKTIDAKVEDFEAMIDTNVKGLIYSTKAVLPLLYKQEKGYIFNIGSTAGSWPYPGSNVYGATKAFVKQFSLNLRNDLVGTNIRVTNIEPGLCKTEFSEVRFRGDKVKADSLYENTNFITSEDIATILINCLNMPGSVNINRVEVMANTQTWAGLAIEKF

SEQ ID NO: 1180 - protein, 240 aa, Artificial Sequence
  Synthetic
MKSVIITGATRGIGLALARFYADKGYCLMLNGGHNEEALAAVEKELSTKTQVITCLGSVAEEKTAAAIVQKTLDTFGQIDLLINNAGIAHIGLLSDMSSEEWHTLMGTNLDAVFYMSKAVIPHMVHRHSGKILNVSSVWGEVGASCEAAYSASKGAVNSLTKALAKELAPSHISVNGVSFGVIDTDMNRCFDEEERASLAEEIPYGRFASPEEAAAFCYQITESPEYLTGQIIRFDGGWI

SEQ ID NO: 1181 - protein, 269 aa, Artificial Sequence
  Synthetic
MSVCTPKSFDLTGKVALITGASYGIGFAIATAMANCGATIVFNDIKQELVDKGLAAYKEAGITAHGYVCDVTNEDAVNAMVKQITEEVGHINILVNNAGIIKRIPMCEMTAAQFRQVIDVDLNAPFIVAKAIIPDMIEQGGGKIINICSMMSELGRETVSAYAAAKGGLKMLTKNIASEYGQYNIQCNGLGPGYIETPQTAPLRETQPDGSRHPFDQFICAKTPANRWLKPEELTGPAVFLASEASNAVNGHILYVDGGILAYIGKQPQ

SEQ ID NO: 1182 - protein, 255 aa, Artificial Sequence
  Synthetic
MSALFDLTGKTALVTGSARGLGFAYAEGLAAAGARVILNDIRETLLAESVDALASKGYSAHGAAFDVTSEEAIEKAFAELDAQDIHVDILINNAGIQYRKPMVELELENWQKVIDTNLTSAFLVSRTAAKRMIARRSGGKIVNIGSLTSQAARPTVAPYTAAKGGIKMLTCSMAAEWAQFNIQSNAIGPGYILTDMNTALIEDKQFDNWVKDSNPSQRWGRPEELIGTAVFLSSKASDYINGQIIYVDGGWLAVL

SEQ ID NO: 1183 - protein, 248 aa, Artificial Sequence
  Synthetic
MKLLEGKTALITGAARGIGKALALRFAQNGANIAFTDLVIDENAEQTKREIEELGVKCAAYASNAADFAQTAEVVDKIKVDFGHIDILVNNAGITKDGLMLRMTEGQWDAVINVNLKSAFNFIHAVLPLMMRQRKGSIINMASVVGVHGNAGQANYAASKAGLIALAKSIAQEVGSRGIRANAIAPGFIETAMTAALPEDIRKDWIQKIPLRRGGTTEDIANVALFLASDLSSYVSGQVIQVDGGMNM

SEQ ID NO: 1184 - protein, 240 aa, Artificial Sequence
  Synthetic
MRKTVLVTGSSRGIGASIIKKFAMNNFDVIINYLNSENEALSLKKEIITKYNVKCETIKCDISKETDVINMAGYIKDKFGKIDILVNNAGICNDMILDFKTYDDFKKVIDVNLNGTFLVTKYISKLMKSGSIVNISSTNGIDTYYPESIDYDASKAGVISLTHNFAKTFAPKIRVNAICPGWVETDQNKELSIKQIKGIKKGILLKRFAKPEEIANVVFFVANESYINNAVIRVDGGSIC

SEQ ID NO: 1185 - protein, 269 aa, Artificial Sequence
  Synthetic
MSNFNLNQFSLTGKVALVTGASYGIGFAIASAYANAGATIVFNDINHELVDKGLKAYQENGIQAHGYVCDVTDEEAVNHMIHKIENDVGVIDILVNNAGIIKRIPMCDMSADDFRKVIDVDLNAPFILSKAVIPSMIKKGHGKIINICSMMSELGRETVSAYAAAKGGLKMLTRNIASEYGEFNIQCNGIGPGYIATPQTAPLRELQEDGSRHPFDQFIISKTPAARWGNPEDLMGPAIFLASDASDFVNGHVLYVDGGILAYIGKQPQ

SEQ ID NO: 1186 - protein, 255 aa, Artificial Sequence
  Synthetic
MSKQRIIAITGASGGLAQEIVKQLSPRDGIILLGRDKDKLVKCYRHVENKTCLAIDLRDDNAIKEMVDYLFQRFGRIDVFINNAGFGEFKSYANYTSQEVRDMFEINTFATMSFSRLMAEKMVEQGHGHIINIASMAGKIATANSSVYAATKFAVIGFSDALRLELADKGVYVTTVNPGPIETSFFDQADPSGAYLESVKKFVLSPKYVAKKIVRILGKNKREVNLPRLLAVAHKFYTLFPKIADYLARTSFNYK

SEQ ID NO: 1187 - protein, 248 aa, Artificial Sequence
  Synthetic
MNKVVLITGGARGIGSAIALELAKHGYDIVINYLTSKQPAKELKEKIESEYHVRCLTICADVSDVDQVNIMVSEIEEKMGGVDILINNAAVDLSNLFHLKNAEEFKRTLDVNVVGAFNCSKRVYKHMLDQEYGRIINISSTNGINTYYPMCIDYDASKAALISMTHNLAAEFGPYINVNCVAPGFIGTDNELDGYDEEFLKEETEKIMVKRYGKPEEVAYLVRFLISDEANFINNSIIRIDGGQMGSC

SEQ ID NO: 1188 - protein, 240 aa, Artificial Sequence
  Synthetic
MKTAIITGAARGIGAATAKLFAEKGFNVCVNYVRSEEKAQALARALPSAVAIKADVSIKEEARALIETAVETFGGIDVLVNNAGIALPQKLVTDVSDGEFNGIFNTNIKGTHNAVSAALPYMISRKSGSIVNLASLWGVRGGSCEAVYTSSKAAVIGYTKALAAEVGPSGIRVNCVAPGFIMTDMNAHFSKEDIEAFASDTPLEKVGSPEDVAKAIYFLASDDSSFITGQTLCVDGGRSV

SEQ ID NO: 1189 - protein, 269 aa, Artificial Sequence
  Synthetic
MVGYKELKNLQGRIVLITGASSGMGEQIAYQAAKKGAIVIGCARRIEKLEEVVATCRRISGNDAYAFQVDVSIPNQIERVVEKVESSIGPIDVLVNDAGFGLMKEALDFDMAIAERMFRVNVLGLMYMSKYVALHMAERRRGAIINIASIAGKIATPKASVYSATKFAVLGYSNALRLELKPLGISVLTVNPGPVRTDFFDIADESGHYLDSIGALSLNPEIVAEKVVKSIGTSRRELNLPEYMQLAHHLYELCPRLGDYLAGGIFNKK

SEQ ID NO: 1190 - protein, 255 aa, Artificial Sequence
  Synthetic
VRKVAVVTGSSRGIGYGILRRLGKDGFQVVMVATGEMYKNQAALEELKSEGIECVYIQANIGNKEDREKIVSETVKAYGRIDVLVNNAGVAPKERADLLEMTEESFDRVLSINTKGNMFLTQLVAKQMLKQNIEGKKRGTIINISSCSAEVSSISRGEYCVSKAGVSMLTTLYADRLAKEGILVHEVRPGVIATDMTSTVQGKYDKLIEDGTFPIARWGTPDDIAGAVSAFAGDNFLYTTGNYIDVDGGFHIKRL

SEQ ID NO: 1191 - protein, 248 aa, Artificial Sequence
  Synthetic
MKGTAFITGATSGFGDAIARRLSLDGYKIIALGRRKERLEKLAGELGNTHIIAADIRDKKAVFDAVKNLPENFKDIEVLVNNAGLALGQEKTIDASIEDFETMVDTNIKGLLYSTKAVLPIMTQRKSGYIFNLGSVAGHWPYPGGNVYGGTKAFVKQFSYNLRNDLLGTGIRVTEIAPGLCKTEFSEVRFKGDKAKADSIYANTQFITADDIATMVLNCLNLPKSVNVNLLEVMATTQTWAGFYFERD

SEQ ID NO: 1192 - protein, 240 aa, Artificial Sequence
  Synthetic
MKSILITGATRGIGLALARFYADKGCCLTLNGGHDKDALAAVEKELSKKTRVISCFGSVAEEKTAITMTQKAMDTFGQIDLLINNAGISHIGLLSDMTSEEWHTLMGTNLDSVFYMSKAVIPHMLHRHSGKILNISSVWGEVGASCEAAYSASKGAINALTKALAKELAPSHISVNGISFGVIDTDMNRCFDEEERAALSEEIPYGRFASPEEAAAFCYQITESPEYLTGQIIRFDGGWI

SEQ ID NO: 1193 - protein, 269 aa, Artificial Sequence
  Synthetic
MERRSWLNLDGKTVIVTGGASGIGRAVAQELLWDGANVAVCDCSTQEPAFETGAGRCLYVSADVTDPESISDMVEKVKSMLGTIYGLVNNAGINIPRLLVDPDHQYELDEAVWNRVMDVNVKGVFLCAQAVARELEKNGGGVIVNVSSECGLEGSEGQSVYAASKNAVNSLTRSWAKELGKRGIRVVGIAPGILEATGLRTAAYEEALAYTRGITVDELHKSYAKTATIPLGRSGKLCEVANVAAFLLSERSSYIHGVTINVAGGKTRG

SEQ ID NO: 1194 - protein, 254 aa, Artificial Sequence
  Synthetic
MNNGVFGLEGQKILITGASSGIGRATAQLAAAQGAICIINGRDGTRLNETLSTLEGEGHIAIASELTPENCSALVKEAVAKAGALNGFVHCAGIEKTLPFRMTELSDLHEIMSINLDSYWEITKEILKKKNHEPQKLSVVAISSVAGQYGAAGKTAYAASKGALISLTKSLAAEYAGQGIRFNCVCPGYVNTPMLGNVKRLYKTKEDFESAIEKKHLLGLGEPDDVASAVVYLLSVAAKWVTGSVMNVDGGYNL

SEQ ID NO: 1195 - protein, 248 aa, Artificial Sequence
  Synthetic
MKLLEGKTALITGAARGIGKALALRFASEGANVAFTDLVIDESGHETEREIEAYGVKAKGYASNAADFQQTKEVVEQVKADFGRIDILVNNAGITKDGLMMRMTEQQWDAVINVNLKSAFNFINAVLPIMLRQRSGSIINMASVVGVHGNAGQSNYAASKAGLIALAKSIAQEVGSRGIRANAIAPGFIETAMTAALPDDIRAEWTKKIPLRRGGKVEDIANVATFLASDMSSYVTGQVIQVDGGMNM

SEQ ID NO: 1196 - protein, 240 aa, Artificial Sequence
  Synthetic
MKTVVITGASKGIGLALARFYGAHRWNITINGGHDAQALASAAKELSSLTCVTTYLGDLSSEEHASGLIAHALQTFGKIDLLINNAGISHIGLLSSMTTAQWRTVMGTNLDAVFYTSRAVIPHMVRRQEGKILNISSVWGEAGASCEAAYSASKGAVNALTKALAKELAPSGISVNAVSMGVIDTAMNRCFTEEERAALAEEIPFGRFATPQEAAAFCYQVTQSPSYLTGQILRFDGGWL

SEQ ID NO: 1197 - protein, 269 aa, Artificial Sequence
  Synthetic
MAQCTPKSFDLTGKVALITGASYGIGMAIAKAMAANGATIVFNDIKQELVDKGIAAYEEAGIKAHGYVCDVTNEEAVNAMVAQIEKEVGTIDILVNNAGIIKRIPMTEMTADQFRQVIDVDLNAPFIVSKAVIPAMIKKGHGKIINICSMMSELGRETVSAYAAAKGGLKMLTKNICSEYGQYNIQCNGLGPGYIETPQTAPLREIQPDGSRHPFDQFICAKTPANRWLKPEELTGPAVFLASEASNAVNGHILYVDGGILAYIGKQPQ

SEQ ID NO: 1198 - protein, 254 aa, Artificial Sequence
  Synthetic
MCMDNCIKRYENKIVLVTGASRGIGAAIAARFAKEGAVVIVNYSGNDEAADRTVENILAANGKAEKYKCQVDSYEETEKMITYIMDKYKRIDILINNAGITKDGLIMRMKEEDFDRVIDVNLKGTFNCIRHVSRYMLKQRSGRIINMSSVVGIAGNAGQVNYSASKAGVIGITKSAAKELASRGITVNAVAPGYIDTDMTKVLSDEQKKSVLDMIPLSRMGSVDDISNAVAFLASDEAAYITGQVISVDGGMNI

SEQ ID NO: 1199 - protein, 248 aa, Artificial Sequence
  Synthetic
MKLLEGKVAVITGAARGIGKEIALKFASEGCDIAFTDLVIDENGKKTEEEILAYGVKCKGYASNAADFAATEATVQEIKKDFGRIDILVNNAGITKDGLMLRMTEQQWDAVIAVNLKSAFNYIHAVLPIMMRQKSGSIINMASVVGVHGNAGQSNYAASKAGLIALAKSIAQEVGSRGIRANAIAPGFIETAMTAALPDDIRAEWVQKIPLRRGGKVEDIANVATFLASDMSSYVSGQVIQVDGGMNM

SEQ ID NO: 1200 - protein, 240 aa, Artificial Sequence
  Synthetic
MRTALVTGASRGIGAAIARGLAADGYRIAVNYHSRESDAKALCRELQQITGLPHILVRADVSDRSQVESMFHTIGEVDVLVNNAGIAQQKLFTDLTEADWDRMFDVDVKGVFHCCQLALPHMIHQKSGAIVNISSMWGQVGASCEVHYSAAKAAVIGFTKALAKELGPSHIRVNCIAPGVIDTEMNALLGAETLEALREETPLELLGSPIHIADAVRFLVSDRASFITGQVLGVNGGMVI

SEQ ID NO: 1201 - protein, 269 aa, Artificial Sequence
  Synthetic
MQPQVILITGASSGFGKITAQMLSEQGHIVYGTSRKPSGNMNNVKMLVADVTNILSIHEAVGQIISEQGRIDVLINNAGMGIGGALELATEDEISGQMNTNFFGVVNMCKVVLPYMRKARRGKIINISSIGGVMGIPYQGFYSASKFAVEGYSEALALEVHPFNVKVCLVEPGDFNTGFTDNRNISELTRQDSDYGESFLNSLKIIEKEERNGCHPRKLGSSICKIVARKNPPFRTKVGPVVQVLFAMSKSWLPDRVMQYALRLFYAIK

SEQ ID NO: 1202 - protein, 254 aa, Artificial Sequence
  Synthetic
MRNLFDLSGKRALITGSAQGIGHLLAGGLAEYGAEIIINDRTQARADQAAQALVAQGFHAVGVAFDVTRAAQVEQAIARIEEEIGAIDILINNAGIQRRFPFTEFPEEEWDNVIEVNQKGVFLVSQQVAKYMMGRRAGKIINICSMQSELGRKTITPYAASKGAVKMLTRGMCVELAEYNIQVNGIAPGYFATDMTAALVNDEAFSAWLYQRTPAARWGKPEELIGAAVYLASSAANFVNGHLLFVDGGMLAAV

SEQ ID NO: 1203 - protein, 248 aa, Artificial Sequence
  Synthetic
MNFNPFSLHNKTVLVTGASSGIGQAIAIACSKMKANVVLTGRNAVKLDFTLSQMEVGNHLILRADLTDENDINELVEQLPMLDGIVYNAGIGNRKLCKMIDKNDINSVMNVNFSSAVLLQSSILSAKKINKGASIVFVASRAAISPSIGNAIYSASKGAIISYAKCLGLELAPRQIRVNCICPAMVWTDLIMQEGISKEELEEAQLKYPLKRYGQPEDIAYLSIYLLSDVSGWMTGSVLDITGGESKL

SEQ ID NO: 1204 - protein, 240 aa, Artificial Sequence
  Synthetic
MKKTAIVTGASGDIGKEIARFLLEKNYTVVGIYFNNNEALDELIDIYGDNLHTLKCDLSSFSCGKEIADYISGNNLNVNLLINNAGISIIGLLQDLNEDLWNKIWNTNVTSAISVSQALIPLFLKQGYGQIINISSVWGNCGASCEVAYSTTKGAINTFTKALAKELAPSNIQVNGIACGIIDTKMNSHLDSEDIASIIEEIPVGRLGTPEDVAKTVYSISEAGSYLTGQIITLDGGWTS

SEQ ID NO: 1205 - protein, 269 aa, Artificial Sequence
  Synthetic
MEVIDQPSVHPVAIVTGASSGIGLEYARELCSRGYDVVMVSNEEERLTRCAGELSQTYEVQTWPLYMDLSLPDAAEHLHGFCVALGLQVEVLVNNAGIFRFEHIVNLSVGVVRTMLMLHMNTVVLLCRYFGEDMRKRGKGYILNMSSMSAWFPYPGISLYASTKCFLKSFSRAFRLEMLDYGVNVTTVCPGAIATDLYNLPLHLQRLAVRIGVMMKPDTLAHRAINGMFRHRSQMIPGVINYFFIGFLFFLPYGVVRWVMRKVKRAIET

SEQ ID NO: 1206 - protein, 254 aa, Artificial Sequence
  Synthetic
MGRLEGKVAVITGGNSGVGEQAAKRFAKEGAKVVITARRKEKLESVAADIEAAGCTVLALQGDISVPGDGKRIVEAAVEHFGTLDILVNNAGVLDEGLLPIDKVADSEIDRIIDINTKGTMYFIRAALEVMLKNKSGSIINVDSIAGVNGGGGAAYVASKAAGLGITKHTAMRCAKDGVRCNAICPGMIKTPMTAGQTMDSMDPDMMGAMAVHSDLRLPACSAEDVANSILFLASDESAPITGQCIVLDYGANL

SEQ ID NO: 1207 - protein, 248 aa, Artificial Sequence
  Synthetic
MKLLEGKVAIVTGAARGIGKAIAMRFAEEGASVVFTDLKVDENFQNTEKELQALGVKAKGYASNAADFEDTAGVVAQIVKDFGRIDVLVNNAGITRDGLMMRMSEQQWDMVINVNLKSAFNFIHAVTPVMMKQKSGSIINMASVVGVSGNAGQTNYSASKAGLIGLAKSIAKELGPRGIRANAIAPGFIITDMTNALSDEVKAEWAKQIPLRRGGTPEDVAKVALFLASDLSSYVSGQVIHVCGAMNT

SEQ ID NO: 1208 - protein, 240 aa, Artificial Sequence
  Synthetic
MTKTIFITGGSRGIGEALVKKCAGKYNVAFTYNRSKERAQKLQDELNSVYGGVFAVFCEVSDAQSVSAAVSAVKKRFGRIDILVNDAGIAKSGLFIDTTIDDWHEMFSVNVDGVFNVTKAVLPDMLSHSNGSIVNVSSVWGVKGASMEVAYSATKAAVIGFTKALAKEVAPMGVRVNAVAPGAISTDMMKVYSDSDVHDLCDNAIPLSRLGTPDEVADAILYLANAEYVTGETLVISGGM

SEQ ID NO: 1209 - protein, 269 aa, Artificial Sequence
  Synthetic
MSVCTPKSFDLTGKVALITGASYGIGFAIATAMANCGATIVFNDIKQELVDKGLAAYKEAGIEAYGYACDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGVAEDLGGPAVFLASEASDFVNGLILYVDGGILAYIGKQPG

SEQ ID NO: 1210 - protein, 254 aa, Artificial Sequence
  Synthetic
MTNVFTADALKDQVVFVTGASRGIGAGILDACLAAGATVIGTATSESGAARITEKISQAGGKGEGVVLNVTDAEQSEKVLADVAAKYGAVTVLVNNAGITRDGLAMRMKDEQWQEVIDTNLTPAFRLSRIVMRGMMKARCGRIINIVSVVGSMGNAGQANYAAAKAGVAGLTRALARELASRNITVNAVAPGFIETDMTRALPEDHRQALLTQIPLARLGQTDDIANAVLFLASPAASYITGVTLHVNGGMYMV

SEQ ID NO: 1211 - protein, 248 aa, Artificial Sequence
  Synthetic
MIVLVTGATAGFGECITRRFIQQGHKVIATGRRQERLQELKDELGDNLYIAQLDVRNRAAIEEMLTSLPAEWRNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDDKAEKTYQNTVALTPEDVSEAVWWVATLPAHVNINTLEMMPVTQSYAGLNVHRH

SEQ ID NO: 1212 - protein, 240 aa, Artificial Sequence
  Synthetic
MNKVILITGASSGIGEGIARELGKAGAKVFLGARRLERIHALADEIRSAGGEAEAQVLDVTSRQSMAAFVEAAREKWGRIDVLINNAGIMPLSPLSAGKQDEWERTIDVNIKGVLWGIGAVLPIMEAQGSGQIVNIGSIGALSVVPTAAVYCATKFAVRAISDGLRQESSNIRVTCINPGVVESELASTITHEETMAVMDAYRAIALKPADIARAVRHIIEAPESVDTTEITIRPTASAN

SEQ ID NO: 1213 - protein, 269 aa, Artificial Sequence
  Synthetic
MSVCTPKSFDLTGKVALVTGASYGIGFAIATAMANCGAKIVFNDIKQELVDKGLAAYKEAGIEAHGYVCDVTNEDAVNEMVKKITAEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGKAEDLGGPAVFLASEASDFVNGLILYVDGGILAYIGKQPG

SEQ ID NO: 1214 - protein, 254 aa, Artificial Sequence
  Synthetic
MAEKQEIQEQVALVTGASRGIGAAIARALAARGCNLALNHSSEHSAQACAELADDLQREYGIKAVVFCADVSSFEAAKEMVEGVREQLGRIDVLVNNAGVTQDGLLARMSEEAFDKVISVNLKGAFNCMRHVAPVMMKQRSGRIINISSVVGLYGNAGQVNYAASKAGIVGMTKSAAKELGARGITVNAVAPGFIDTDMTRALSEKTREGVVSRIALRELGSAEDVAGAVSFLASNEARYITGHVLTVDGGLSL

SEQ ID NO: 1215 - protein, 248 aa, Artificial Sequence
  Synthetic
MGLLTGKTAIVTGAARGIGKAIALKFASEGANIAFTDLVIDENGQNTEKEIAALGVKVKGYASNAANFEDTEKVVNQIKEDFGSIDILVNNAGITKDGLMMRMSEAQWDAVIAVNLKSAFNFIHACTPIMMRQKSGSIINMASVVGVHGNAGQCNYSASKAGMIGLAKSIAQELGSRGIRANAIAPGFIITDMTAKLSDEVKAEWAKKIPLRRGGTPEDVADVATFLASDMSSYVSGQVIQVDGGMNM

SEQ ID NO: 1216 - protein, 240 aa, Artificial Sequence
  Synthetic
MELCGKTALITGASSGLGRAIAFRFVQEGAQVVGIGRRNTVAEHAFRYVCCDITKEEQVQALVQTLTKVDILVNCAGVTAVGSLKTTKTQTLRQQFEVNVFGLYELTRQVLPLLEQSREGVIVNVGSELGRWAKADRIAYCPSKAAVEMLTRCMALELAPGIRVNGIMPGLMDTSMTRQRFEDSKDPAAARLEAGNRYLLKRLCTVEDAVEAALFLASSRSRFITGEMLAVCGGGQSDTR

SEQ ID NO: 1217 - protein, 269 aa, Artificial Sequence
  Synthetic
MSVCTPKSFDLTGKVALITGASYGIGFAIATAMANCGATIVFNDIKQELVDKGLAAYKEAGINAHGYVCDVTNEDAVNEMVKKITEEVGHIKVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGEAEDLGGPAVFLASEASDFVNGLILYVDGGILAYIGKQPG

SEQ ID NO: 1218 - protein, 254 aa, Artificial Sequence
  Synthetic
MTNVFTADALKDQVVFVTGASRGIGAGILDACLAAGATVIGTATSESGAARITEKISQAGGKGEGVVLNVTDAEQSEKVLADVTAKYGAVTVLVNNAGITRDGLAMRMKDEQWQEVIDTNLTPAFRLSRIVMRGMMKARSGRIINIVSVVGSMGNAGQANYAAAKAGVAGLTRALARELASRNITVNAVAPGFIETDMTRALPEDHRQALLAQIPLARLGQTDDIANAVLFLASPAASYITGVTLHVNGGMYMV

SEQ ID NO: 1219 - protein, 248 aa, Artificial Sequence
  Synthetic
MGLLTGKTALITGAARGIGKAIALKFAEEGANIAFTDLQIDENGKATESEIAAKGVKVKGYASNAADFAQTEEVVKAVKEEFGSIDILVNNAGITKDQLMLRMTEQQWDAVIAVNLKSAFNFIHACVPVMMRQRGGSIINMASVVGVHGNAGQSNYAASKAGLIALAKSIGQEMGPKGIRANAIAPGFIETAMTAALPEQVRKDWMTKIPLRRGGTVDDVANTALYLASDLSSYVSGQVIQVDGGMNM

SEQ ID NO: 1220 - protein, 240 aa, Artificial Sequence
  Synthetic
MKSVLVTGGAGGIGEAICLKFAEKGYFVGVGYNNSETEAKKIAEKIGGAAIKIDVTDAESVNSAVESFAKHSGTNGAINVLVNCAGIALPIKTLLDVTDAEYDKIFAVNMKGVFLSVKAVLPHMLEKGGAIINVSSMWGLSGGSCEAVYSASKSAVIGFTKALAKEFAGANIRVNAVAPGFIDTKMNNAFSEEDRELIGEDIPLGRFGLPEDVAKAVLYLADDADFVTGITLNVSGGEVV

SEQ ID NO: 1221 - protein, 269 aa, Artificial Sequence
  Synthetic
MSVCTPKSFDLTGKVALITGASYGIGFAIATAMANCGATIVFNDIKQELVDKGLAAYKEAGINAHGYVCDVTNEDAVNEMVKKITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREVQPDGSRHPFDQFIVAKTPAERWGKAEDLGGPAVFLASEASDFVNGLILYVDGGILAYIGKQPG

SEQ ID NO: 1222 - protein, 254 aa, Artificial Sequence
  Synthetic
MTRFTGKTAIITGASSGIGACTAKTLAAEGGNLVLAARHPEKLQAIARECTDLGAQVLTVCADVSKETDCNHLSQAAMERFGAIDILVNNAGIADKHRPIDRLDVDWYRQVLEINQNSVFYMMQAVLPHMKEAGKGSIVNISSIGAVRSNSGLAYTTAKTAVIGMSKNVALEFAAGNIRVNVVCPGPTPTALNTPEQIATFDSDFAALCNSHMALDGVPQCTVQDQANAIAFFASDDSAGITGQVLTVDHGMTI

SEQ ID NO: 1223 - protein, 247 aa, Artificial Sequence
  Synthetic
MLLEGKVALVTGASRGIGKAIALLLAENGADVAVNFAGSTAAAEAVAAEIEKMGRKAILVQGDVSQTEVCAEMVDKVVKELGHIDILVNNAGITRDTLLLRMKEEDWDAVLNTNLKGVFNCTKAAVKYMAKQRSGAIVNISSVVALMGNAGQANYAAAKAGILGFTRSVAKEMAARGIRVNAVTPGFIKTDMTSVLSEKVVAAMEASIPLARLGEPEDIAKAVLFLVSDNAAYITGQTLHVDGGMVM

SEQ ID NO: 1224 - protein, 240 aa, Artificial Sequence
  Synthetic
MDKVILITGASSGIGEGIARELGTTGAKVLLGARRLERIGAIAAEICRAGGIAKARALDVTDRQSMSGFVQAALDSWGRVDVLINNAGVMPLSPLAAGKQDEWELTIDVNIKGVLWGIGAVLPVMEAQGSGQIINLGSIGALSVVPTGAVYCATKFAVRAISDGLRQESSKIRVTCVNPGVVESELASSITHVETIKAMDAYRSVALQPADIARAVRHIIESPESVDTTEITIRPTASAN

SEQ ID NO: 1225 - protein, 269 aa, Artificial Sequence
  Synthetic
MNRVIIITGTRKGIGYFLAEKYLNEGDIVYGCSRRECEINHENYHHTRLDVSDEPAVIAFVRNVYKEQKRIDILINNAGIGIGGALELATEEEVNIQMNTNFFGVVNMCKAVLPSMRKARKGKIINISSIGGVMGIPYQGFYSASKFAVEGYSEALALEVHPFHIKVCVVEPGDFNTGFTDNRNISEQTRLDADYGESFLKSLEIIEKEERNGCHPRKLGAAICKIVERTNPPFRTKVGPWIQVLFAKSKKWLPDAVMQYALRIFYAIK

SEQ ID NO: 1226 - protein, 254 aa, Artificial Sequence
  Synthetic
MTQSVFTADALAGEIVLVTGASRGIGAAILDVCVKAGATVIGTATSDSGAAKISARIQELGGKGEGRVLNIADREGTDAFMKALEADFGSVTVLVNNAGITRDTLSMRMKDSQWDEVIETNLTGGFRLSRACLKGMMKARHGRIINIASIVGMMGNAGQANYAAAKAGTIAMSKSIAREIGSRGVTVNCVAPGFIATDMTDALNDAQKQALLAQIPLGRLGSADDVAEAVVFLASSAAAYITGQVIEVNGGMRM

SEQ ID NO: 1227 - protein, 247 aa, Artificial Sequence
  Synthetic
MVLRMARKTVLVTGASRGIGKAIAVKFAKKGYNVAISCVHSKERLLQTQKEIQSYQVPCLAYMGDMGDMKCCEEWFEQVKKQFGGADILINNAGIAYIGLLQDMSTEDWEKMLHVNLTSVFNCCKLAIPYMVRQKQGKIVNISSVWGLAGASCEAAYSATKGGVNALTKALAKELAPSGIQVNAVACGAIDTEMNQWLEEEELISLVEEIPAGRLGRAEEVADLVYHLSYKDSYLTGQVIGLDGGWI

SEQ ID NO: 1228 - protein, 240 aa, Artificial Sequence
  Synthetic
MQKVILITGASSGIGEGIARELGNAGAKVLLGARRLERIEAIAAEIRGAGGVAQARELDVTSRLSMASFVQDALDKWGRVDVLINNAGIMPLSPLAAGKQDEWERMIDVNIKGVLWGIGAVLPVMEAQGSGQIINIGSIGALAVVPTAAVYCASKFAVRAISDGLRQESPTIRVTCVNPGVVESDLASTITHPQTRAAMDVYRSVALKPADIARAVRQVIEAPESVDTTEITIRPTASAN

SEQ ID NO: 1229 - protein, 269 aa, Artificial Sequence
  Synthetic
MSVCTPKSFDLTGKVALVTGASYGIGFAIATAMANCGAKIVFNDIKQELVDKGLAAYKAEGIEAKGYVCDVTSEEQVNAMVAQIEKEVGIVDILVNNAGIIKRIPMVEMTAAEFRQVIDIDLNGPFIVSKAVIPSMIKKGKGKIINICSMMSELGRETVSAYAAAKGGLKMLTRNIASEYGEYNIQCNGIGPGYIATPQTAPLRERQADGSRHPFDSFIVAKTPAARWGTPEDLMGPAVFLASDASDFVNGHILYVDGGILAYIGKQPQ

SEQ ID NO: 1230 - protein, 254 aa, Artificial Sequence
  Synthetic
MGRLEGKVAIITGGNSGVGEQTAKRFAKEGAKVVITARRKEKLESVAADIEADGGTVLALQGDISVPGDGKRIVEAAAEHFGTLDILVNNAGVLDEGLLPIDKVADSEIDRIIDINTKGTMYFIRAALEIMLKNKSGSIVNVDSIAGLNGGGGAAYVASKAAGLGITKHTAMRCAKDGVRCNAICPGMIKTPMTAGQTMDSMDPDMMGAMAVHSDLRLPACSAEDVANSILFLASDESAPVTGQCIVLDYGANL

SEQ ID NO: 1231 - protein, 247 aa, Artificial Sequence
  Synthetic
MADQEKTALVTGASRGIGKAVALALADKGFTVVINYAGSHDAAEAVKAEIESKGGKALTLQGDVSKAEDVDRIFSTIKKELGGLDVLVNNAGINRDALLIRMKENQWDDVINTDLKSDFLTIKAAAMMMMKRKKGSIINVSSVVGITGNVGQVNYASAKAGVIGLTKACAKELAGRNIRVNAVAPGFIETDMTETIPDNLKEGMLRSIPLGRMGQAEEVAKAICFLASDDAEYITGQVLKVDGGMVM

SEQ ID NO: 1232 - protein, 240 aa, Artificial Sequence
  Synthetic
MLKTALVTGASRGIGAAVARGLAEDGYRVAGVYCRSQEEMASLAASCGVIPIAADLAQTETLPRLAETVLEQLGQVDVLVNNAACSYINLFQCMPPEQVRRLYAVNLTAVVELSRLLLPSMISRHTGCIVNISSMWGETGASCEVDYSVTKGAVLAFTRALAKEVGPSGIRVNAVSPGTIATDMVAHLPQETLDELAKETPLGRLGKPEDVADAVRFLVSDRAAYITGQDIPVNGGFWCG

SEQ ID NO: 1233 - protein, 269 aa, Artificial Sequence
  Synthetic
MSVCTPKSFDLTGKVALITGASYGIGFAIATAMANCGATIVFNDIKQELVDKGLAAYKEAGINAHGYVCDVTNEDAVNEMVKKITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGEYNIQCNGIGPGYIATPQTAPLREIQPDGSRHPFDQFIVAKTPAGRWGEAEDLGGPAVFLASEASDFVNGLILYVDGGILAYIGKQPQ

SEQ ID NO: 1234 - protein, 254 aa, Artificial Sequence
  Synthetic
MKTALVTGASRGIGLAIARELGINGYHVAVMATRDESFYPESTKILLEAGISYAWYVGDIGKSEDRIRIVREAAEKFGEIHVLVNNAGVAPKVRADLLEMTEESFDYVIGTNTKGNMFMTQAAARQMMKQPVYGGKRGTIINISSCSSQVSSVNRGEYCVSKAGISMLTKLFADRLAPEGIFVYEIRPGVIRTDMTSQVEEKYTELIRQGMFPIARWGVPEDVAKAVRAFCSDDFCYTTGNYIDVDGGFHIQRL

SEQ ID NO: 1235 - protein, 247 aa, Artificial Sequence
  Synthetic
MENVEKSALVTGASRGIGRAIAIALASRGYCVALNYAGSREAAEKVKEEIEAAGGRAFTLQGDVSKSEDVDRIFKTVKEEFGGLDVLVNNAGINRDALLIRMKEENWDDVIATDLKSDFLTIKAAAPIMMRKRKGSIINISSVVGLMGNIGQANYAAAKAGVIGLTKACAKELAARHIRVNAVAPGFIETAMTDGIPEKIREGMIASIPLGRMGQPEDIAKAVCFLASDDAVYITGQVLVVDGGLVM

SEQ ID NO: 1236 - protein, 240 aa, Artificial Sequence
  Synthetic
MDKVILITGASSGIGEGIARELGNAGAKVLLGARRLERIEAIAAEISNHGGIAEARELDVTNRVSMAEFVQTALDYWGRVDVLINNAGIMPLSPLAAGKQDEWERTIDVNIKGVLWGIGAVLPVMEAQGCGQIINLGSIGALSVVPTAAVYCASKFAVRAISDGLRQESSKIRVTCVNPGVVESELASTITHAETMAVMDAYRSVALKPADIARAVRHVIEAAESVDTTEITIRPTASAN

SEQ ID NO: 1237 - protein, 269 aa, Artificial Sequence
  Synthetic
MDQANKWLDLSGKVVIVTGGSMGLGEKMVENLSANGANVVYADLAPNQSFNEMEGITFIKCDVTKKTQVEALTQTVVEKFGHIDGLVNNAGVSRPRLLVDVFKQKPEYELSEDDFDFMVGVNQKAVYLVSQAVARQMVEQQSGVIINMTSEAGVQGSRGQSCYSATKAAVNAFTFSWAKELGPFNVRVVSVEPAINVPTPMNSEANFRALAYTRGTDPSHVHKDYKGIIPLGRPGKLEEIADLISFLVSDRSSYITGSVINITGGKSHH

SEQ ID NO: 1238 - protein, 254 aa, Artificial Sequence
  Synthetic
MGKTALITGASSGIGEAVARKLAAAGYNLVITARRSGRLQKLSDELEEKYGIKVHALGFDIRERIQTESAIEALPAHFRAIDVLINNAGLASGLEPIDEGDPLDWDKMIDTNVKGLLYITRVVSRMMIERGQGGLIVNIGSVAGSQTYADGAVYCASKHAVHALSEGMRIDLLKHGIKVSEVRPGMVETEFSVVRFHGDRQRADKVYEGVKPLSAEDIADVIGWIVSLPPHVNVNDILVMPTQQADAHYTDRKP

SEQ ID NO: 1239 - protein, 247 aa, Artificial Sequence
  Synthetic
MKLEGKKALVTGASRGIGRAIALALAAEGADVVVNYAGSEAAAKEVAAEIEAMGRKAFVVQADISSNEAATAMVDEVVKEFGRIDILVNNAGITRDGLLMRMKEEDWDAVLTTNLKGVFNCTKAAVKYMMKQKAGKIVSISSVVGLMGNAGQANYAAAKAGVIGFTKSVAKEVAARGINVNAVAPGFIKTDMTSVLSDKVVEGMLTSIPLHKLGETTDIAKAVVFLVSDDANYITGQTLHVDGGMVM

SEQ ID NO: 1240 - protein, 240 aa, Artificial Sequence
  Synthetic
MNKVILITGASSGIGEGIARELGKAGANVFLGARRLDRINALAAEIHSAGGEAEAAVLDVTSRQSMADFVQAAREKWGRIDVLINNAGIMPLSPLSAGKQDEWERTIDVNIKGVLWGIGAVLPIMEAQGSGQIINIGSIGALSVVPTAAVYCATKFAVRAISDGLRQESSNIRVTCVNPGVVESELASTITHPETMAAMDAYRAIALKPADIARAVRHIIEAPESVDTTEITIRPTASAN

SEQ ID NO: 1241 - protein, 269 aa, Artificial Sequence
  Synthetic
MSVCTPKSFDLTGKVALITGASYGIGFAIATAMANCGATIVFNDIKQELVDKGLAAYKEAGITAHGYVCDVTNEDAVNAMVKQITEEVGHINILVNNAGIIKRIPMTEMSAAQFRQVIDVDLNAPFIVAKAIIPDMIAQGGGKIINICSMMSELGRETVSAYAAAKGGLKMLTKNIASEYGAYNIQCNGIGPGYIATPQTAPLREIQPDGSRHPFDQFIVAKTPAGRWGEAEDLGGPAVFLASEASDFVNGLILYVDGGILAYIGKQPQ

SEQ ID NO: 1242 - protein, 254 aa, Artificial Sequence
  Synthetic
MPKNVLITGATSGIGEATARAFAKEGASLILTGRRVERLQALKEELQATYLKQKIWTFALDVTDMEMVKDVCQAILKSAGQVHVLVNNAGLALGLTAYQDYEEWDLLTMLDTNVKGLMMVTRQILPSMVAANEGHIINMGSTAGIYAYAGAAVYSATKAAVKTFSDGLRIDTIASDIKVTTIQPGIVETDFSQVRFHGDKDKAAKVYQGLEALQAQDIAEAVLYVTKQPRRVQISDMTIMANQQATGFTIHRGE

SEQ ID NO: 1243 - protein, 247 aa, Artificial Sequence
  Synthetic
MENLGKTALVTGASRGIGRAIALMLASRGYAVALNYAGSREAAEAVKTEIENAGGKAFTIQGDVSVSEDVDRIFKTIKTEFGGLDVLVNNAGINRDALLIRMKEENWDAVIATDLKSVFLTTKAAAAMMMRKKNGAIVNISSVVGLTGNIGQANYAAAKAGIVGFTKACAKELAARNIRVNAVAPGFIGTDMTDKIPEDLKANMLQSIPLGRMGQAEDVAKAVCFLASDEASYITGQVLNVDGGMVM

SEQ ID NO: 1244 - protein, 240 aa, Artificial Sequence
  Synthetic
MRVLITGTTSGIGKTIMNHFIELNYEVYTINRKNINNNNITNYVCDLSDINQVQELIKTIDKLDIDILINNAGAGYPSKIENISLDSIYYETNLNFLTPYLLIQNIYPKMIKKKYGRIINISSISSKRGTPYLYTYSATKAALDSLTQSIASTASNYGFTINSICPGGIDTNMSINGRIEISNLKNMKDNEYQNGMINEMCLGKLIPTKAVVYLIDYLLSEKANCISGQSINICGALEVK

SEQ ID NO: 1245 - protein, 269 aa, Artificial Sequence
  Synthetic
MQPQIILITGASSGFGKITAQMLSEQGHIVYGTSRKPSENIGKVRMLVVDVTNSISVRQAVEQIISEQGRMDVLINNAGMGIGGALELATEEEVSMQMNTNFFGVVNMCKAVLPYMRKARRGKIINISSIGGVMGIPYQGFYSASKFAVEGYSEALALEVHPFHIKVCIVEPGDFNTGFTDNRNISEATRVNTDYKESFLKSLEIIEKEERNGCHPKKLGHAICKIVARKNPPFRTKVGPWIQVTFAKSKKWLPDVVMQYALRIFYAIQ

SEQ ID NO: 1246 - protein, 254 aa, Artificial Sequence
  Synthetic
MKTALVTGASRGIGLAIARELGVNGYQVAVMATRGESFYPESTRTLRDAGISYAWYAGDIGKSEDRIRIVREAAEHFGEIHVLVNNAGVAPKVRADLLDMTEESFDYVIGTNTKGNMFMTQAVARQMMKQPVYGGKRGTIINISSCSSQVSSVNRGEYCVSKAGISMLTKLFADRLAPEGIFVYEIRPGVIRTDMTSQVEEKYTELIKQGMFPIARWGVPEDVAKAVRAFCSDDFCYTTGNYIDVDGGFHIRRL

SEQ ID NO: 1247 - protein, 247 aa, Artificial Sequence
  Synthetic
MKLEGKIALVTGASRGIGRAIALALAAAGADVAVNYAGSEAAAKEVAAEIEAMGRKAMVVQADISSNEASTAMIDQVVKEFGRIDILVNNAGITRDGLLMRMKEADWDAVLTTNLKGVFNCTKAAVKYMMKQKYGRIVSISSVVGLMGNAGQANYAAAKAGVIGFTKAVAKEVAARGINVNAVAPGFIKTDMTSVLSEKVVENLVAGIPLNRLGEPDDIAKAVLFLVSDDANYITGQTLHVDGGMVM

SEQ ID NO: 1248 - protein, 240 aa, Artificial Sequence
  Synthetic
MKTVLITGASRGIGAETARVFAERRGEYNVIINYNKSAGEAKALAEETGGYPIKADISVPEQVESMIDKIEDKFGGVDILINNAGISKFNLFTDITEDEWSEVMEVNLNGPYRVTRGVVRHMINNHFGSIINISSMWGVVGSSCEVAYSTAKSGLIGMTKALAKELGPSNIRVNCIAPGVIDTDMNAGLDENTVRELISETPVMRIGKPRDVGELAYFLSGSGAEFITGQVIGVNGGFVV

SEQ ID NO: 1249 - protein, 269 aa, Artificial Sequence
  Synthetic
MSVCTPKSFDLTGKVALVTGASYGIGFAIATAMANCGAKIVFNDIKQELVDKGLAAYKEAGIEAHGYVCDVTNEDAVNEMVKKITEEVGHINVLVNNAGIIKRIPMIEMTAAQFRQVIDVDLNAPFIVAKAVIPDMIEQGGGKIINICSMMSELGRETVSAYAAAKGGLKMLTKNIASEYGEYNIQCNGMGPGYIATAQTAPLREVQPDGSRHPFDQFITAKTPAGRWGDPEDMVGPCVFLASHASDFVNGQILYADGGILAYIGRQPK

SEQ ID NO: 1250 - protein, 254 aa, Artificial Sequence
  Synthetic
MHYLRIMELTYTDKVALVSGAGRGIGREIALELAKAGCTVICVSRNESSCGSVAEEIRACGGKAESFAFDVSDSGQVKEKCAEILKKYGAVDILVNNAGITRDNLLMRMSDEEWNAVISTNLSSCFYLSRNLVRAMMGKRWGRIINISSVSGIAGNAGQANYSAAKAGIIGFTKTLARELAARNITANAVAPGFIETDMTAKLPENIMEAAKAAIPLKRFGKPDDIARVCAFLASEEASYITGQVISVNGGLVI

SEQ ID NO: 1251 - protein, 247 aa, Artificial Sequence
  Synthetic
MEIFMNRTVLVTGASRGIGRAIASAFAAEGDRLIITCSRSEQELLNFKKELEETFHTEVLASVGDISSFEYVEQLFEQITERFGGVDVLINNAGISYIGLLTDMSIDDWNRIVSTNLTSVFSTSRLAIPHMVHEKKGKIINISSVWGIAGASCEVAYSACKGGINSFTKALAKELAPSNIQVNAIACGVIDTQMNACFSEEERAELADEIPAGRFGTPEETAHLAVQLATGNEYLTGQIITLDGGWL

SEQ ID NO: 1252 - protein, 240 aa, Artificial Sequence
  Synthetic
MKKTAIVTGSSGDIGKAIVKKLIANGYTVVGTYFKDETSIKKLAGESGSGFYGYQCDLSDFDAAKDLIHYIEEKNLKVELLVNNAGISETGVLQDLTRESWERIWNTNVTSALSLSQSVIPLFLKHGGGKIINISSVWGNCGASCEAAYSATKGAVNTLTKALAKELAPSNIQINAIACGFIQTKMNARLSSEDIHAITEEIPAGRLGNTEDVAETVYAMLTASPYMTGQIITLDGGWTV

SEQ ID NO: 1253 - protein, 269 aa, Artificial Sequence
  Synthetic
MKELDKYISLAGKNIVITGAGQGIGLAVAKLFVKYGGRVAMIDHSGRSFQEAEKIGENAIAFKCDISDETQVKKTVSDILEEFKTIDILVNNAAIIVRKNIVDTTAEEWDQAMNVGVRGTFLFSKYVLPVMIRQKKGNIINTASNCAVSATPGAASYNAVKGAVASLTRAMAVDHAEDNIRVNCVCPGDVITPMLINEGIQTGKITTGNPQTEEEIAAWDAFIRECGSHRPMGRISTPEEIAYTYLYLATDMSGYATGSSVIVDGGRVC

SEQ ID NO: 1254 - protein, 254 aa, Artificial Sequence
  Synthetic
MKTALVTGASRGIGLAIARELGVNGYQVAVMATRGESFYPESTRTLRDAGISYAWYAGDIGKSEDRIRIVREAAEHFGEIHVLVNNAGVAPKVRADLLTMTEESFDYVIGTNTKANMFMTQAVALQMMKQPLHRDKRGTIINISSCSAEVSSVNRGEYCVSKAGISMLTKLYADRLAPEGIFVYEIRPGVIRTDMTSQVEEKYTELIKQGMFPIARWGVPEDVAKAVRAFCSDDFCYTTGNYIDVDGGFHIRRL

SEQ ID NO: 1255 - protein, 247 aa, Artificial Sequence
  Synthetic
MTLENKTAIVTGGSRGIGRAICVALAQAGANVVTCYAHGAAGAEETVKLCETYGVKASAIQADVAKNEDVQALVAKVKEEYGSIDILVNNAGITKDNLMLKMTEEDFEQVIDTNLKGAFLCIKHVSKIMLKQKRGHIINISSVVGVRGNAGQVNYASSKAGLIGMTKSVAKEIGSRGITVNAVAPGFIETDMTANLPEAVVEENLKSIPMKKLGKVEDVANLVRFLASDDASYITGQVICVDGGMAM

SEQ ID NO: 1256 - protein, 240 aa, Artificial Sequence
  Synthetic
MKKTIIVTGVTGGIGSQIARKFILMGDIVIGVYNKSESVAMQLKKEFGANLHLYKCDLSDFDCGEKLLLYIEEKGLQPDLLINNAGISIIGLLQDLTKDFWNNIWNTNVTSAISLSKALIPLFLRNGHGKIINISSVWGERGASCEVAYSATKGAINSFTKALAKELAPSNIQVNALSCGIIDTKMNSHLSSEDISSIVEEIPAERMGTPQDVADAVLSLTYFNSYMTGQIITIDGGWMV

SEQ ID NO: 1257 - protein, 269 aa, Artificial Sequence
  Synthetic
MSVCTPKSFDLTGKVALITGASYGIGFAIATAMANCGAKIVFNDIKQELVDKGLAAYKEAGIEAYGYVCDVTNEDAVNEMVKKITAEVGHINVLVNNAGIIKRISMIEMTAAQFRQVIDVDLNAPFIVAKAVIPDMIEQGGGKIINICSMMSELGRETVSAYAAAKGGLKMLTKNIASEYGKYNIQCNGIGPGYIATPQTAPLREIQPDGSRHPFDQFIVAKTPAERWGEAEDLGGPAVFLASEASDFVNGLILYVDGGILAYIGKQPG

SEQ ID NO: 1258 - protein, 254 aa, Artificial Sequence
  Synthetic
MKERIIVITGASGGLAEEIIKRLPQTDQLVLLGRDKEKLEDMYAYRERVTCFQIDIKDDEAVQDIIDTIYQKFDRIDIFINNAGFGEFKDFDHYSNRDIRDMFDVNTLATINFSRLVGQKMAEVQSGHIINIASMAGLIASSKSTIYSATKFAVIGFSNALRLELADKEVYVTTVNPGPIATKFFDKADPSGNYLKSVEEFTLQPDDVAKKIVAIFGKNKRELNMPFLLKAAHKAYILFPKLSDFLTRKVFNYK

SEQ ID NO: 1259 - protein, 247 aa, Artificial Sequence
  Synthetic
MQIDLTGKKALVTGASRGLGRAIALSLARAGADVVITYEKSADKAQAVADEIKALGRHGEAVQADSASAQAIQDAVTHAARSLGGLDILVNNAGIARGGPLESMTLADIDALINVNIRGVVIATQEALVHMADGGRIINIGSCLANRVAMPGIAVYAMTKSALNALTRGLARDLGPRGITVNLVHPGPTNSDMNPEDGEQAEAQRQMIAVGHYGQPEDIAAAVTFLASPAAGQISGTGLDVDGGLNA

SEQ ID NO: 1260 - protein, 240 aa, Artificial Sequence
  Synthetic
MRKFENKVVVVTGGAKGIGKAIAGEFRKAGAQVCIIDLLETDGFVGDIADPATLEQFAQTVIAKHGHVDYLINNALPLMKGIDECSYEEFNYALRVGVTAPFYLTKLFAPHFAHGAAIVNISSSRDRMSQPQTESYTAAKGGISALTHALAVSLSGRVRVNSVSPGWIDTDYTVYEGSDAAQHPAGRVGNPLDIANIVLFLCSDKAGFITGENICIDGGMTRQMIYHNDFGWTLQGGKDL

SEQ ID NO: 1261 - protein, 269 aa, Artificial Sequence
  Synthetic
MEKNFLQNFSLEGKIALVTGASYGIGFGIATAFARCGATIVFNDIKQELVDKGLAAYKELGIEAHGYVCDVTDENAVNALVAQIEKEVGVIDILVNNAGIIKRIPMCEMSAAEFRQVIDVDLNAPFIVSKAVIPGMIKKGHGKIINICSMMSELGRETVSAYAAAKGGLKMLTRNICSEYGEYNIQCNGIGPGYIATPQTAPLRERQPDGSRHPFDSFIVAKTPAARWGTPEDLQGPAVFLASDASNFVNGLVLYVDGGILAYIGKQPK

SEQ ID NO: 1262 - protein, 254 aa, Artificial Sequence
  Synthetic
MPKNVLITGATSGIGEATARAFAKEGENLILTGRRVERLQALKEELQATYPDQKVWTFALDVTDMDMVKDVCQAILKSVGQVHVLVNNAGLALGLTAYQDYEEWDLLTMIDTNVKGLMMVTRQILPSMVATNEGHIINMGSKAGIYAYAGAAVYSATKAAVKTFSDGLRIDTIATDIKVTTIQPGIVETDFSQVRFHGDKDKAAKVYQGLEALQAQDIAEAVLYVTKQPRRVQVSDMTIMANQQATGFTIHREE

SEQ ID NO: 1263 - protein, 247 aa, Artificial Sequence
  Synthetic
MENIEKTALVTGASRGIGRAIALALASKGFAVALNYAGSHDAAEAVKKEIEAAGGKAFTVQGDVSKSEDVDRVFKAVKDEFGGLDVLVNNAGINRDALLIRMKESNWDDVIATDLKSDFLTTKAAAAMMMRKRKGSIINISSVVGIMGNIGQANYAAAKAGVIGLTKACAKEMAARNIRVNAVAPGFIETAMTDGIPEKIREGMISSIPMGRMGQPEDVAKAVCFLASDDSSYITGQVLVVDGGLVM

SEQ ID NO: 1264 - protein, 240 aa, Artificial Sequence
  Synthetic
MRKTVLVTGSSRGIGASIIKKFAMNNFDVIINYLNSENEALSLKNEIITKYNVRCETIKCDVSKEEDVINMTGFIKAKFGKIDVLVNNAGICNDMILDFKTYDDFKKVIDVNLNSTFLVTKYISKLMKSGSIVNISSTNGIDTYYPESIDYDASKAGVISLTHNFAKIFAPKIRVNAICPGWVETDQNKELSIKQIKDIKKNILLKRFAKPKEIANVVFFVANESYINNAVIRVDGGSIC

SEQ ID NO: 1265 - protein, 268 aa, Artificial Sequence
  Synthetic
MTEQHSWKQEEDKEGIAMKFENKVAIITGSTRGIGRATAELFAKEGAKVIVVGTKEELGESCVNEIKAAGGEAIFCKTDVTSDESLDNLVKTALDAYGKIDILVNNAGVGGTTANMDQITMDEWNTVLATNLTAPFVLCKKLIPIMEKQGAGTIVNVASMAATAAGRGGLAYTSAKHGLLGLTRQMSLDHGRTGVRINAVLPGPIATDMIARVLAIPQHPVTMKIGMSPAKRPGEPIEVAQAIAFLASDEASFIHGAALTVDGGYTIF

SEQ ID NO: 1266 - protein, 254 aa, Artificial Sequence
  Synthetic
MNRLAGKVAIVTGGNSGVGKATAILLAKEGAKVVISARRQPQLDEVAAEIKESGGEVTTVVTDISKPEDAANLVAKTIEAYGKLDILINNAGVLEEGLKPIDKVLDEDMNKIIDTNTKGTMYCMREAAKEMAKSGTGSIVNVASVAGVMGCGGAAYVASKAAVLGITKHTALRFAGTNIRCNAICPGTIVTPMVANMRPDNMDADMFGNMAKHADLKVQPCMPEDVANIILFFASDESRAITGQTIVSDFGSTL

SEQ ID NO: 1267 - protein, 247 aa, Artificial Sequence
  Synthetic
MNLAGKVALVTGGSRGIGRAIALTLAEHGADVAINYAGNTAAAEEVAAAIEKLGRKALLVQGSVADTNGVADIVGRVVKELGRLDILVNNAGITRDGLLMRMKEADWDDVMNTNLKGVFNCSKAVLRTMMKQKGGRIVNMASVVGEMGNAGQANYASAKAGVIGFTKSLAKEVASRNITVNAVAPGFIATDMTSVLTDEQKAEMACTIPLGRAGEPQDVANAVLFLVSDEAAYITGQVLNVDGGMVM

SEQ ID NO: 1268 - protein, 240 aa, Artificial Sequence
  Synthetic
MDKVILITGASSGIGEGIARELGSTGAKVLLGARRLDRIEAIAAEIRSTGGIADARELDVTNRLSMAQFVQSALDNWGRVDVLINNAGIMPLSPLAAGKQDEWERTIDVNIKGVLWGIGAVLPVMEAQGSGQIINLGSIGALSVVPTAAVYCASKFAVRAISDGLRQESSKIRVTCVNPGVVESELASTITHAETMAVMDAYRSVALKPTDIARAVRHVIEAPESVDTTEITIRPTASAN

SEQ ID NO: 1269 - protein, 268 aa, Artificial Sequence
  Synthetic
MANYLDNFSLEGKVALITGASYGIGFAIAKAMAGAGATIVFNDIKQELVDKGLAAYKEEGIEAHGYVCDVTNEDAVNELVAKVEKEVGVIDILVNNAGIIKRIPMTEMTAAEFRQVIDVDLNAPFIVSKAVIPSMIKKGHGKIINICSMMSELGRETVSAYAAAKGGLKMLTKNIASEYGEYNIQCNGIGPGYIATPQTAPLREIQPDGSRHPFDQFIVSKTPAGRWGEAEDLGGPAVFLASDASNFVNGLVLYVDGGILAYIGKQPK

SEQ ID NO: 1270 - protein, 254 aa, Artificial Sequence
  Synthetic
MENQVFASNALEGRIALVTGASRGIGDAIAQSFARMGAFVIGTATSESGAAGITERLAAAGKGRGVVLNVTNYAEAEELVSSIVKEFGKLDILVNNAGITRDGLLMRMKDADWDDVIATDLTSVFHLCRAACRPMLKARYGRIINLSSVVASSGNGGQTNYSAAKAGLIGFTRSIARELGSRGVTANCITPGFIDTDMTKNLPEEHRAAMTAQIPLGRLGQTDDVANAACFLASPAAAYVTGAVLPVNGGMYMG

SEQ ID NO: 1271 - protein, 247 aa, Artificial Sequence
  Synthetic
MLLEGKNALITGAARGIGAAMVEVFAREGANVWAFARTPDARFEARLAMAAGKYGVWIRPVYCELTDTAALKEAFRQVMADKQPLNVLVNNAGIMGEDRMFQMTGEEDMRRIMDVNFFAMVEVSRLATRLMARNKCGAVVNIASVAGIEGDSRLDYSASKAAVIAATKKMARELISVGIRVNALAPGFTDTDLVSGLSEKVTQEQLGRILMGRKARPEEIADVAAFLASDRASYVTGQVWRVDGGML

SEQ ID NO: 1272 - protein, 240 aa, Artificial Sequence
  Synthetic
MDKVILITGASSGIGEGIARELGTTGAKVLLGARRVERIEAIATEICRAGGIAKARELDVTDRQSMADFVQVALDSWGRVDVLINNAGVMPLSPLAAGKQDEWELTIDVNIKGVLWGIGAVLPVMEAQGSGQIINLGSIGALSVVPTGAVYCASKFAVRAISDGLRQESSKIRVTCVNPGVVESELASTITHVETMKAMDAYRSVALQPADIARAVRHIIESPESVDTTEITIRPTASAN

SEQ ID NO: 1273 - protein, 268 aa, Artificial Sequence
  Synthetic
MCSIVCITHERVDDNRPLPGVNMMKKILVTGASGGIGSQTAVAFAKCGCDVALHFAKNSEKAESLAEKLTNEYGINAFAVQADVSDYESVCKMFDKIDSRFGNLDVLVNNAGIAQQKLFTDITPDEWKKMTGVNLDGVFYCSQQALKRYMIKNHSGVILNISSMWGQVGASCEVHYSASKAGVIGLTKGLAKEVGLSGVRVNCICPGVIMTDMMKGFDEQTVQELKEETPLNMLGMPDDIAETAVFLCSDRARFITGQIVGVNGGMII

SEQ ID NO: 1274 - protein, 254 aa, Artificial Sequence
  Synthetic
MISYDFTGKVVVVTGSARGIGRRIAERFYEAGAVVALCSRSAEGKETLMQEIAGDDRSRIMAASCDVSKPHEIETFLQSVVDKFGTIDVLVNNAGIYSKEDVRDVSEEQWDRVMDTNLKSVFFASQWFCQYHCAAKTTGNIVNIASVSSVTFVPDNALYNVSKAGVVTLTKTFARAMGPNGIRVNAVGPGSIPTDLNAELYKDPQVEKALCEKIPLGRRGTKDDIANCVLFLAAEESSYLTGQVIYAEGGWLLV

SEQ ID NO: 1275 - protein, 247 aa, Artificial Sequence
  Synthetic
MKRFENRTVVITGSNRGLGLEILKQFASEGANIIACMRSEKEETKATLNAIAEENGITITPVYFDMSDEASVKAGCKEIKAMKMPIDVLVNNAGVPHLAILPFTKMQDVHDVFQVNYFSQLLITQSLCGLLSKSAHGAIVNMASIAGIDGEAGNSVYGATKASMILLTKVLSKELAGKVRVNAVAPGLTETDFAEKMGAKAKESMEQSSLMHRLGNPSEIAKTVAFLASDDASFINGQVIRVDGGVK

SEQ ID NO: 1276 - protein, 240 aa, Artificial Sequence
  Synthetic
MKKTVLLTGASGGIGVEITRFLINKGFKVIGTYYSNEDALSFIAQEANGSFFYYKCDLSDFNNINKLMKQLELDGHYPDILINNAGISVIGLLQDLTEKDWNNLWNSNVTSAVGMSKEIIPVFLKKGAGKIINISSVWGNCGASCEVAYSATKGAINSFTKALAKELAPSSIQVNAISCGIIDTKMNAHLTKEDINALCDEIPCGRIGTPYDVAKAVFSLIKTSDYLTGQIITLDGGWTV

SEQ ID NO: 1277 - protein, 268 aa, Artificial Sequence
  Synthetic
MQYRETGGSGPGDGGTGMLTGKSLTGQVAIVTGASRGIGKAVAQALAAEGATVIINYNGSAEAAEAVAADIRSQGGMAEAVKCNVADFAESEAFVKAVTEKYGRVDILVNNAGITRDNLIVRMTEEEFNAVLDTNLKGAFHMIRHLTKTFMKQRYGKIINISSVSGIVGNAGQANYSASKAGLIGLTKSVARELASRNICVNAVAPGFIRTDMTDKLPEAVQDNAVGQIPLKKMGRPEDVAQAVLFLAGDASDYITGQVLCVDGGMAM

SEQ ID NO: 1278 - protein, 254 aa, Artificial Sequence
  Synthetic
MTEKQETQEQVALVTGASRGIGAAVAHTLAAQGFSLALNHSSERSAEACAELAGELREQFGIKAAVFCADVSDFDAAKEMVEQIREQFGRLDVLVNNAGVTQDGLLARMSEEAFDKVISVNLKGAFNCMRHVAPIMMKQRSGRIISISSVVGLYGNAGQVNYAASKAGIVGMTKSAAKELGARGITVNAVAPGFIDTDMTRALSEKARDGVISRIALRELGSAEDVAGAVGFLASKEARYITGHVLTVDGGLSL

SEQ ID NO: 1279 - protein, 247 aa, Artificial Sequence
  Synthetic
MGIALVTGASRGIGKATALQLAREGYTVAVNYHHNIKAATDVINQIVEAGGKAFAVRADISDEAQVLAMFESLDREGEPLSALVNNAGILFEQSTIENLSAERINRVLATNVTGYFLCCREAVKRMSFKHGGKGGAIVNVSSAASRLGAPGEYVDYAASKGAVDSLTTGLSLEVAAQGIRVNCVRPGLIYTDIHASGGEPGRVDRVKALLPMQRGGQPEEVAQAIVWLLSEKASYVTGSFIELAGGK

SEQ ID NO: 1280 - protein, 240 aa, Artificial Sequence
  Synthetic
VKTIFITGGARGIGEATVRRAIGKYNVAFSYLSSEDRAKALEAELGKKGAIFGVKCDVSDPDSVKEAVAAVLKRFGKIDVAVLNAGISYPKMLCDMTSDDVKRTMDVNFYGVFNVTKEILPAMISRKSGKIIAISSMWGETGASLESDYSASKAAVIGFCKSIAKEVALSNINVNVVSPGVIKTDMLKGYSKEELEALKEEIPLSRLGTPDDVADAVMCFADGLDYVTGEVLRVNGGFIC

SEQ ID NO: 1281 - protein, 268 aa, Artificial Sequence
  Synthetic
MADYLNNFSLEGKVALITGASYGIGFAIAKAMAGAGATIVFNDIKQELVDKGLAAYEAEGVKAHGYVCDVTNEEAVNALVAQIEKEVGVIDILVNNAGIIKRIPMCEMSAAEFRQVIDVDLNAPFIVSKAVIPSMIKKGHGKIINICSMMSELGRETVSAYAAAKGGLKMLTKNIASEYGEYNIQCNGIGPGYIATPQTAPLREIQPDGSRHPFDQFIVSKTPAGRWGNAEDLGGPAVFLASDASNFVNGLVLYVDGGILAYIGKQPK

SEQ ID NO: 1282 - protein, 254 aa, Artificial Sequence
  Synthetic
MGRLEGKVAIITGGNSGIGKAAAELFAKEGAKVVISARREAQLLEVAAKIREAGGEALCVTCDISKSDQCAALVEKTVEAYGTVDVLVNNAGVLDSGIFAVEKVSDETIDYLVDINTKGTLYVTRECAKVMLQKKAGSIVNVASVAGYCGNGGAAYVSSKAAVIGLTKNVAMRCADIGVRCNAVCPGSVVTPMTMGLQRDKLDMDMMSAMNKHADNSIKPCMPQEVANVLLFLASDESAAVTGQVMVVDHGANL

SEQ ID NO: 1283 - protein, 247 aa, Artificial Sequence
  Synthetic
MTLEGKTALVTGASRGIGKQIALTLASQGADVIVNYNGSRERAEETVSQIRDMGRKAEALQCSVADFQACGDMVKKALELFGHIDILVNNAGITKDNLVVGMKEEDFDAVIDTNLKGTFNTIRHLYRNFMKLRGGRIINLSSVSGVLGNAGQANYAASKAGVIGLTKSVAKELASRNVTVNAVAPGYIATDMTAAMSDEAKQGIISQIPLKREGRPEDVAELVAFLAGDGGAYITGQVISVDGGMAI

SEQ ID NO: 1284 - protein, 240 aa, Artificial Sequence
  Synthetic
MKQTVLITGASRGIGAAAARLFAAQGYRVAICCHTQMEKAEELAASLPDAAAFTADVAKEADVVRMVDAVHSRFGEIHVLVNNAGIAMQKLFTDTTTEDWNRIFDVNVTGIFYACRAVLPEMIRRKSGRIVNVSSMWGVTGASCEVAYSASKAAVIGLTKALAKEVGLSGITVNCVAPGVIDTEMNANLSAEDRAVLCGETPLARIGTAQEAAQAILFLASDRASFVTGQVLGVNGGIVI

SEQ ID NO: 1285 - protein, 268 aa, Artificial Sequence
  Synthetic
MAASWLNLEGKTIIVTGGASGIGLAIAKELLNDGANVVVCDCNPHKIELGEDHTKFTYLVADVTDRNSIDSLIQKVKKKYGAIDAIINNAGINIPRLLVDDNQQYELDESVWDKVMAVNVKGVFLCAQAAAHEMVRQGHGVIVNMSSECGLEGSEGQSVYAASKNALNSLTRSWAKELGKKGVRVVGVAPGILEATGLRTISYETALAHTRGISIEELREGYENSSTIPLGRSGNLAEVANLVAFICSDRASYIHGVTINVAGGKTRG

SEQ ID NO: 1286 - protein, 254 aa, Artificial Sequence
  Synthetic
MKKRIAVVTGASGGIGKAFVKSLLEEEVDEIWTIARNQKKLEALKQEFGERIVVISMDLSDPSALLEIEAMLQEVNPVVVYLINNAGMAKMGAYSDFTVEEIERTVSVNCTVPAALCALCIPYMERGSRILTLSSASAFQPLPFLNLYASSKVFVRSYSRALHAELKGSGITATAVCPGWVDTDLLTKEVNGKPVRFAGLVTPEKVAAKALRDAKRGKDMSVCTLHVKWEHFLAKVFPQRMAMRTWLRRIRPYF

SEQ ID NO: 1287 - protein, 247 aa, Artificial Sequence
  Synthetic
MNNKKTALITGASRGIGREIARLFAKNNYNVVINYNKSEKEAQELLYELNNENLSARIFKADISNPQEANSLVNYTIGQFEKIDVLINNAGISRFNLFTDISYEEWHEVMNVNLNSVFYVTKKALQYMIPELQGKIINISSMWGIVGSSNEVHYSASKAALIGMTKALAKELGPSNIQVNAIAPGVIETDMIKDIDNDTIDMLKYDTPLMRIGKPIDIAKCALFLAEDGGDFITGQVISSNGGFVIY

SEQ ID NO: 1288 - protein, 239 aa, Artificial Sequence
  Synthetic
MPTPARIALITGASGGIGSAIARRFAAEGFRLALCGRNTEKLEAVCASLPQGTEALLLPGDVNDAGYQDACLAAVQARFGGLDVLVNCAGMAQSDAFEDITPARFDEIMTLNCRTPFFLCQKALPLLRQSQAASILNIASVTAHKGYVRQAAYAASKHAMAGFTKTLAAEVYEQGIRVHLISPGGVFTDMAKVSRPDLTGEEMITAEDIAEIAAFLVLRRTNAVIDEIEVHRANKAPFA

SEQ ID NO: 1289 - protein, 268 aa, Artificial Sequence
  Synthetic
MNYTLDSLFGVKDEVIVVCGGTRGIGREIANGLADLGAKLAIVATKQFACDQAAEELKARGAQDAIGCAADVTDFAAVQAAFAKIYEHYQKIDGLVNCAGINKALPLLEIDMADFNHVVDVNFTGIVHCCKAAGTYMLPAHKGRIVNVSSLSALQGKAKYTAYSASKAAINGFTRALSTEWCAQGINVNVLSPGLVVTDINRATVMANPDGYRRRIEAIPRGVPGRVEWLVGPVVMLLSPGSVHLTGQVICVDGGISTGDTFVMDKKQ

SEQ ID NO: 1290 - protein, 254 aa, Artificial Sequence
  Synthetic
MTGRLTGKVAIVTGAGSGMGKAISQLFAKEGAKVALADINAQGIEEVKQAIEQAGGQAAAKVTNVVKQEDVDGVIDFATQTFGQLDILVNNAGIMDNFTPVGNLTDAEYERVMAINLTGPVKLCRVAIQVMEKQETGGVIINNASVGGLFGTRGGAAYTMAKHALVGLTKNIAGTYGRFGKVRANVIAPGGVATNIQTTITAPDPLGMQALQATGETPIGQPGQIANLALFLASDEASFINGDIVKADGGWTVN

SEQ ID NO: 1291 - protein, 247 aa, Artificial Sequence
  Synthetic
MTLENKTAIVTGGSRGIGRAICVALAEAGANVVTCYAHGAAGAEETVKLCEAYGVKASAIRADVAKNEDVQALVTKVKEEYGSIDILVNNAGVTKDNLMLKMTEEDFEQVIDTNLKGAFLCIKHVSKIMLKQKRGHIINISSVVGVRGNAGQVNYASSKAGLIGMTKSVAKEIGSRGITVNAVAPGFIETDMTAKLPEAVVEENLKSIPMKKLGKVEDVANLVRFLASDDASYITGQVICVDGGMAM

SEQ ID NO: 1292 - protein, 239 aa, Artificial Sequence
  Synthetic
MRLNGKVAVVTGGAKGLGGEMCQLFAKEGAKVVAVDMMPLTYENANVEFYKLNVTSSEDCKEFYDYVIKKYGKVDVLVNNAGITRDAMTRKMTDEMWNAVISVNLTGVFNLTRLIGPQMEEIGGGSIINISSVVGEFGNIGQANYSATKAGVIGLTKTWAKEFARKGVPVRVNAIAPGYIMTDMMKTVPEDLLKKFAGQTMLGRLGQPIEIANAALFLASDEASYVTGHLLSVNGGMRL

SEQ ID NO: 1293 - protein, 268 aa, Artificial Sequence
  Synthetic
MCSIVCNTHERADGNRPLPGVNMMQKILVTGASGGIGSQTAVAFAKCGCDVALHYSKNSEKAESLAKKLTNEYGINTFAVQADVSDYESVCRMFDEIDSRFGNLDVLVNNAGIAQQKLFTDITPDEWKKMTGVNLDGVFYCSQQALKRYMIKNHSGVILNISSMWGQVGASCEVHYSASKAGVIGLTKGLAKEVGLSGVRVNCICPGVIMTDMMKGFDEQTVQELKEETPLNMLGMPDDIAETAVFLCSDRAKFITGQIVGVNGGMII

SEQ ID NO: 1294 - protein, 254 aa, Artificial Sequence
  Synthetic
MNRFQEKVVVVTGAGSGIGAAAARRFAHEGASVVLVGRTKEKLDKVAATLAQGKHLVAPCDVSDAQQVQSLAQRVADEFGRVDVVVNNAGVIVQGKIHEITLEDWETLMGTDLNGVFYCLHAFMPGLLKTKGNVINISSVSGLGGDWGMSVYNAAKGAVTNFTRSLAMDYGADGVRVNAICPGFTFTELTEDMKQDEALLQKFYERIPLQRAGEPEDIADAIAFLASDDARYITGVNLPVDGGLTASNGQPKQA

SEQ ID NO: 1295 - protein, 247 aa, Artificial Sequence
  Synthetic
MLLENKTAIVTGSAKGIGKGIATEFAKQGATVVINYCGSKEAALKTVEEIKAFGGKAIPYQADISDYEMSKKMMDDIIKEYGAIDILVNNAGITRDNLILRMSESEFDDVIRTNLKGTFNCIKHVTKYMLKNKSGKIINISSISGVNGIAGQANYSASKAGIIGLTKSFAKEMSSKGININAIAPGFIETDMTKVLNDKYVEEIVNTIPSKRVGRPEDIAKAALFLASDMSDYITGQTLMVDGGLGL

SEQ ID NO: 1296 - protein, 239 aa, Artificial Sequence
  Synthetic
VATAFVTGGSRGIGAAIVRALASECNVAFTYRASEKEARALEEELKVCGGVKAFFCDVSDPLSVREAVRAARERFGGAEMLVNCAGISGRGLFQDVTDEEWRRMFAVNCDGAFYVTRELLPYMIEKKRGSIVNVSSVWGVRGGACEAAYSASKAALIGMTLALAKEVAPSGIRVNALAPGAVDTDMMKCYGEEELADICRDIPLGRLASPEEIASAAVFLLRHGYVTGQVLTVDGGFTA

SEQ ID NO: 1297 - protein, 268 aa, Artificial Sequence
  Synthetic
MADYLNNFSLEGKVALITGASYGIGFAIAKAMAGAGATIVFNDIKQELVDKGLAAYKEEGIEAHGYVCDVTNEDAVNEMVSKIEKEVGVVDILVNNAGIIKRIPMCDMTAAEFRQVIDVDLNAPFIVSKAVIPSMIKKGHGKIINICSMMSELGRETVSAYAAAKGGLKMLTKNIASEYGEFNIQCNGIGPGYIATPQTAPLREIQPDGSRHPFDQFIVSKTPAGRWGEAEDLGGPAVFLASDASNFVNGLVLYVDGGILAYIGKQPK

SEQ ID NO: 1298 - protein, 253 aa, Artificial Sequence
  Synthetic
MKGKTIFITGATSGIGEGCARKFASAGCRLILNGRNVEKLEALKRELVLSGCEVLTLPFDVRDREAMKLALDSLQEEWKNIDVLINNAGLVIGLDKEHEGSLDEWGVVIDTNIKGLLAMTRMVVPGMVERQCGHIINIGSVAGDAAYAGGSVYCATKAAVKALSDGLRIDLVDTPLRVTNIKPGLVETNFSVVRFRGDKSKADAVYKGIRPLTGDDIAEVVYYAASAPAHVQIAEVLVMPTYQANGTVCHRNV

SEQ ID NO: 1299 - protein, 247 aa, Artificial Sequence
  Synthetic
MFNPFSLENKNILVTGASSGLGVGIAIDCSKMGANMVVTARNEERLNRTMRELEKANNFSIIADLVKDEDIEDLVEKVPVLDGVVLCAGVIKTMPVKNIKFDAIDEIFDINIISSIKLLKLLLKNKKLAFGASVVFISSVSTFNVKIGNSLYSATKGAVNSFAKVMALEVAKQKMRVNCIQPGFVPSNILGQGVIESEDYIRFYAERHPLGFGTRDDIGYACIYLLSDAARWVTGSIFTIDGGYTLQ

SEQ ID NO: 1300 - protein, 239 aa, Artificial Sequence
  Synthetic
MKTVLITGASSGIGEGLAKSFAADGYLVIACGRDPSRLEALQQFSPNISVRLFDMTDRDACRQALEGCSADLVILCAGTCEYLDHGVVDAALVERVMSTNFLGPVNCLAALQTQLKPGSRVVLVSSMAHWLPFPRAEAYGASKAALSWFADSLRLDWEPKGIAVTVVSPGFVDTPLTRKNDFSMPGQVSVGQAVTAIRRGLAKGKKHIVFPGAFGWLLRSLSSLPAVVQRAFLRRMVRP

SEQ ID NO: 1301 - protein, 268 aa, Artificial Sequence
  Synthetic
MKLTGKTAVVTGGTKGIGAELCRLFSQAGANTVCLARSCGEGEKNGIFYIPCDVCDAAAVENAFRAIGEKFGGVDFLINNAGMGISGSVEKTSERDFDSISDVNFKGTYNCIRFGLPLLRQSKGRLVNVSSVAGAIAIPYQAFYSATKAAVLSLSDALRNEVRPFGVKVLAVLPGDVKTCFTESRRKNADEGVYAAYAENSVKVMEKDEQQGMSAAYAAKKIFVCAVKRNMPHVKVIGVKYKFLYFAAGILPRRLKDWLLFKIYGGES

SEQ ID NO: 1302 - protein, 253 aa, Artificial Sequence
  Synthetic
MGRLDGKVCIVTGASAGIGRATAELFCREGAKVVAVARREERLKELAEECKDLPGELVWYAGDVGDPETAVGMVKKAVETFGKLDVAVNDAGIMDDNTAIADLSDEMLHETFRINTFGLMYGMREECRQYLAQGDGGVIVNICSVGATHQTSGAAYCASKGAVLAATKNTAFMYMEEGIRCNAVSPGGVVTDIPLVMPPSDEFGFGRTSKLLDFSGELAMPEDLADAILFLASDQSRYVNGEELKCDGGWTCF

SEQ ID NO: 1303 - protein, 247 aa, Artificial Sequence
  Synthetic
MLLDGKVALVTGASRGIGRAVAIELAKEGATVAINYAGNVAAAEEVKNIITDMGGKAMIVQADVSDEQAASEMVEKVIAEFGQIDILVNNAGITRDGLFIRMKSQDWNAVINTNLTGIFNCTKVVAKYMMKKRSGKIINMTSVSGIMGNIGQTNYSAAKAGVIGFTKSLAREMASRGITVNAVAPGFIATDMTAAMPEKAQAQVVGSIPLGKMGQPEDIANAVVFLASDKASYITGQVVNVDGGMVM

SEQ ID NO: 1304 - protein, 239 aa, Artificial Sequence
  Synthetic
MKYIMITGASSGIGEETARLLARQEDVTTILVARNEEKLKKLVNEFGGETKYLVYDLTDVWHIESCFIKCREWGIKLDGLIHCAGIGENMPIRLIQTEHIKKMYQIHPMAFIELGKYFSKRKYSNDGSSIVVMSSMAAYEMEKGMAAYASSKAAVNAVVKVMAKEMADRRIRVNGVAPAFVATPMIKEDMDMWEKEGNSPQKFGVIPPKQVAGLIGFLMSEQAAYITGEIISISAGMIY

SEQ ID NO: 1305 - protein, 268 aa, Artificial Sequence
  Synthetic
MEKVNAMFSLEGKVALVTGASYGIGFALATAFARAGAKIAFNDIKQELVDKGLAAYKEEGIDAKGYVCDVTNEEQVNELVAKIEKELGSVDILVNNAGIIKRIPMVDMSAAEFRQVIDVDLNAPFIVSKAVIPGMIKKGAGKIINICSMMSELGRETVSAYAAAKGGLKMLTRNIASEYGEYNIQCNGIGPGYIATPQTAPLRERQADGSRHPFDSFIIAKTPAARWGTPEDLMGPALFLASKASDFVNGHVLYVDGGILAYIGKQPK

SEQ ID NO: 1306 - protein, 253 aa, Artificial Sequence
  Synthetic
MGRLEGKVAIITGANSGIGKATAERFALEGADLVLAARRLDKLKEVEAYAVAQGVRALSVATDVSQPEDCRRLVEAAVAAFGCIDILVNNAGIDDKNKSITNCDLELWEKVISTDQNSVYFMMKEVLPHMERAGQGSIVNISSIGATRSNAGISYTAAKMAVIGMTKNVAIQYAGTGIRCNAVCPGPTETPIFSPENAAAFDKEFARACARHFDGSVPRTQPEDQANAILFFASDESKAVNGETLVVDYGGTI

SEQ ID NO: 1307 - protein, 247 aa, Artificial Sequence
  Synthetic
MQLTGKTAIVTGGSRGIGRAAALTLAEAGADVAVIYAGNTAAAEETVRLIEEKGRKGLAIQCDVADEAAVTAMVKDVKKELGRIDILVNNAGITRDGLLMIMKEADWQAVLDTNLTGAFHCTKAVTRLMMKQRSGSIINITSVVGETGNAGQANYAAAKAGLIGFTKSVAKELASRNIRCNAIAPGCIETDMTAVLGEDTVDAMIKTIPMGRVAQPEEVAKAVLFLASDDASYITGQTLNVDGGMVM

SEQ ID NO: 1308 - protein, 239 aa, Artificial Sequence
  Synthetic
MNKVVLITGASRGIGRDIAEKLAQKGYQVIANYNRSEEKAKELKSKYANIDIYKADVSKREEVHNMIKSILEKYKKIDVLINNAGISLTGLFTDVTDEEWNKIINNDLYSVFCTTQEVLTNMIMRKEGCIINISSIWGIVGSSCESIYSVAKAGVDGMTKSLAKELGPSNIRVNSIAPGIIDTEMNNCYSAEEIEAIKEEIPLERIGKKGDISKCIEWLIEDEYTTGQIISINGGWVIR

SEQ ID NO: 1309 - protein, 268 aa, Artificial Sequence
  Synthetic
MIEQHLWKQEEDKEGITMKFENKVAIITGSTRGIGRATAELFAKEGAKVVVVGTKEELGESCVNEIKATGGEAIFCKTDVTSDESLDNLVNTTLDAYGKIDILVNNAGVGGTTANMDQITMDEWNTVLATNLTAPFILCKKVIPIMEKQGAGTIVNVASMAATAAGRGGLAYTSAKHGLLGLTRQMSLDHGRTGVRINAVLPGPIATDMIARVLAIPQHPVTMKIGMSPAKRPGEPVEVAQAIAFLASDDASFIHGAALAVDGGYTIF

SEQ ID NO: 1310 - protein, 253 aa, Artificial Sequence
  Synthetic
MGRLEGKVCIVTGATAGIGRATAALFCREGAKVVAVARREALLRELAEECKDAPGKMVWYVGDVGEPATAVGMVRKAVDTFGRLDVAVNNAGVMDDNTAIADLSDEMLHEVFRINTFGLMYGLREECRQYLSQGDGGVIVNICSVGATHQTSGAAYCASKGAVLAATKNTAFMYMEQGIRCNALSPGGVVTDIPLVMPPSDEFGFGRTSKLLEFSGELAMPEDLADAILFLASDQSRYVNGEELKCDGGWTCF

SEQ ID NO: 1311 - protein, 247 aa, Artificial Sequence
  Synthetic
LIRMKNKRVLITGSSKGIGKAIAIEMAKCGAEIFLNYHRSEPAAQCTAREIFDLGATCHLMQADLTVPSEIKNLFTKLDQNKQQIDVLVNNAGILQKNYLFGISEADWDTMINTNLKSVFLCSKYAARSMTRAKQGCIINIISTAVEKVMPLQSAYIASKAGVKGLTAALAKELGRYGVRVNGISPGPVFTDMNRFTDEEKRNIIKKIPLNKEITATNIAHAVILLASDYASGINGQILCVDGGLSL

SEQ ID NO: 1312 - protein, 239 aa, Artificial Sequence
  Synthetic
MKTVLITGASSGIGAGLAKSFSADGYHVIACGRDPARLEALHQTCPNLTVRLFDMTDREACRQALTGSYADLIILCAGTCEYLDGGVVDAALVERVMNTNFLGPVNCLEALQPQLVRGNRVVLVSSMAHWLPFPRAEAYGASKAALSWFAESLRLDWEPKGITVTVVSPGFVDTPLTRKNDFAMPGRVTVDEAVKAIRIGLAAGKMHIAFPAGFGFILRLLSGLPAFLQRTLLRRMVRS

SEQ ID NO: 1313 - protein, 268 aa, Artificial Sequence
  Synthetic
MNTLTVMLLFKQGGLNMGKLDNKVAIVTGGNAGVGKAIAKLFASEGAKVVISARRKEVLEEVGKEIEEAGGTVLCVPTDISKIDDVKNLVSKTVEAFGKVDVLVNNAGVLDKGLNAIDRIDYDDLNRVIDINQKGTMYCMSEALKVMTSGASIVNIASVAGQFGAGGAVYVSTKAAIIGVTKHTAMRFAKENIRCNVICPGSITTDMAAGLTPDTMDMKMMGAMSAHSDLSLKPCSPEDVARVTLFLASDDAAPITGQVVVTDYGVDL

SEQ ID NO: 1314 - protein, 253 aa, Artificial Sequence
  Synthetic
MSMKLENKVAIITGSTRGIGRATAELFAKEGAKVVVVGTKEELGKEVAEEIKATGGEAIFCKTDVTSDESLENLVKTTLDAFGKIDILVNNAGVGGTTANMNQITMDEWNTVLATNLTAPFVLCKKVIPIMEEQGAGTIVNVASMASTAAGRGGLAYTSAKHGLLGLTRQMSLDHGRTGVRINAVLPGPIATEMIARVLAIPQHPVTMKMGMSPAKRPGEPIEVAQAIAFLASDDASFIHGAALAVDGGYTIF

SEQ ID NO: 1315 - protein, 247 aa, Artificial Sequence
  Synthetic
MLLEGKTAIVTGASGGIGKAVAIALAKEGAAVAVHFHGNEEKALLVKKEIEEAGGKAEIFRANVADFEECNALVKAVAKTFGSIDILVNNAGITKDGLLMAMSEADFDNVIDTNLKGCFQMIRFASRRMMKQRYGRIINVSSVSGVAGNAGQANYSASKAGIIGLTKSAAKELASRGITCNAIAPGFVKTEMTDVLPDEVKENAKKQIPLGRFAEPEDIANAAVFLASDKASYITGQVLLVDGGMVM

SEQ ID NO: 1316 - protein, 239 aa, Artificial Sequence
  Synthetic
MSTVLVTGGSRGIGAATVRALAGRYNVAFTYNASESNALALERELAGKGGVKAFRCDVSDSASVKKAADEIRKRFGAVDMIVNSAGIAEKGLFQDITDEEWRKIFAVNVDGTFYVTREFLPDMISRQRGAIVNVSSVWGVVGASVETAYSATKAAIIGLTKALSKEVAPSGITVNAVAPGAVDTDMMNCYSAEEKAEICRDIPLGRMATADEIAKAIVFLLENGYVTGQVLTVDGGFAG

SEQ ID NO: 1317 - protein, 268 aa, Artificial Sequence
  Synthetic
MDSYIKNFSLEGKVALVTGASYGIGFAIASGMAAAGAKIVFNDIKQELVDKGLAAYKEAGIDAKGYVCDVTNEEAVQAMVKQIEEEVGVIDILVNNAGIIKRIPMCEMTAEQFRQVIDVDLNAPFIVSKAVIPSMIKKGHGKIINICSMMSELGRETVSAYAAAKGGLKMLTRNICSEYGEYNIQCNGIGPGYIETPQTAPLREIQPDGSRHPFDQFIIAKTPAARWGKTEDLVGPAVFLASDASNFVNGHVLYVDGGILAYIGKQPQ

SEQ ID NO: 1318 - protein, 253 aa, Artificial Sequence
  Synthetic
MGRLDGKVCIVTGASAGIGRATAELFCREGAKVVAVARREDRLRDLAEECSELPGEIIWHAGDVGDPATAVNMVKKAVETFGKLDIAVNDAGIMDDNTAIADMSDTMLMETFRINTFGLMYGMREECRQYLAQGNGGVIVNICSVGATHQTSGAAYCASKGAVLAATKNTAFMYMEEGIRCNALSPGGVVTDIPLVMPPSDEFGFGRTSMLLNFSGELAMPEDLADAILFLASDQSRYVNGEELKCDGGWTCF

SEQ ID NO: 1319 - protein, 247 aa, Artificial Sequence
  Synthetic
MLLEGKVALVTGASRGIGRAIALRLAQEGAAVAINYAGNTAAAEEVKSMIEAQGGKAIIVQADVSDGQAVDAMIKTVVDELGGLDILVNNAGITRDNLLMRMKEEDWDAVLNTNLKSAYYCTKAVTKLMMKKRYGRIVNMTSVVGLTGNISQANYAAAKAGLIGFSKSMAKELSSRGITVNMVAPGFIETDMTAVLSDKVKEAMVAGIPMGRPGKPEDVANAVLFLVSDCASYVTGQVINVDGGMVM

SEQ ID NO: 1320 - protein, 239 aa, Artificial Sequence
  Synthetic
MKKLVVVTGASSGIGMEIAKRFSKEGYPVLMLARRKDVMEELNLPNCMCRSVDVTDLSAMQAAVKEAEEMYGKTDLLINCAGLMLLGYPSEQDFEEWNSMIDVNIKGILTGTKAVLADMMKRNEGTIINISSIAGRKNFDNHSVYCGTKYAVHAITESMRKEVSGSNVRMIVIAPGVVETPLLSHTSSEEIKDNYNLWKQSIEGGLETSQIADCVWFAYQMPQNVCVREIVIAKTKQED

SEQ ID NO: 1321 - protein, 268 aa, Artificial Sequence
  Synthetic
MDFSMDHFRLDGKIALVTGAVYGIGFTIAQSLAAAGATIVFNNLTQESVDEGIKNYQAAGIKAHGYVCDVTDEAAVNEMVKTIEEEVGVIDILVNNAGIIKRIPMLEMSAADFRQVVDVDLNAPFIVSKAVLPSMIKKGHGKIINICSMMSELGRETVAGYAAAKGGLKMLTKNICSEFGEANIQCNGIGPGYIATPQTAPLREIQPDGSRHPFDQFIVAKTPAARWGEPVDLAGPAVFLASDASNFVNGHVLYVDGGILAYIGKQPE

SEQ ID NO: 1322 - protein, 253 aa, Artificial Sequence
  Synthetic
MKQLNEKVAIVTGAGQGIGKGIALCLAKRGVKVIATGRRPDPINQTIAEIKEAGGEGFAMTCDSADRERVDEVVKTAVEKYGTVDVIVNNAQAIVPSAPVEETSYDNMLKAWQSGVIGSLNYMQAAFPYMKEQHEGRIINFASATGMFGIAGQLAYGSNKEALRGLTKIAAKEWGQYGICVNIVLPGAESPAAKAWAEKFPEEYAKQVNLNPMKRFGDPENDIAPVIAFLAGPDSCYYSGQSVIVDGANSIMP

SEQ ID NO: 1323 - protein, 247 aa, Artificial Sequence
  Synthetic
MLLADKIAVVTGASRGIGRGIALAMAREGATVVVNYNGSKERAEEVVAEIENAGGKAVAKQCNVSDFSQAKEFFAEVVKEYGRIDILVNNAGITRDNLIMKMSEEEFQDVIDTNLGGAFNGTKFVTRPMMKQRVGRIINIASVSGVTGNMGQANYSASKAGIIGLTKATAKELAARNITVNAIAPGFIATEMTDKLNDAVKEAAVKTIPLGEFGKVEDIAETAVFLASDKARYITGQVICVDGGIAM

SEQ ID NO: 1324 - protein, 239 aa, Artificial Sequence
  Synthetic
MKKLVVVTGASSGIGMELAKRFSGQGHPVLMLARRSDIMEKLELPNTICRSVDVTDFKGMESAIRGAEAVYGKADLLINCAGLMLLGYPERQDFEEWERMIDVNVKGILTGTKVVLPDMLERNGGTIINISSIAGRKTFDQHSVYCGTKYAVHAITESMRKEVANSNVRFIVIAPGVVETPLLSHTSDQGIKDNYNIWKETIEGGLDTGKIADCALFAYNMPQDVCVREFVIAKTKQQD

SEQ ID NO: 1325 - protein, 268 aa, Artificial Sequence
  Synthetic
MNEYLQNFSLEGKIALITGASYGIGFAIAKAMAGAGATIVFNDIKQELVDKGVAAYKEEGIEAHGYVCDVTNEDAVNELVSVIEKEVGVIDILVNNAGIIKRIPMCDMSAAEFRQVIDVDLNAPFIVSKAVIPGMIKKGHGKIINICSMMSELGRETVSAYAAAKGGLKMLTKNIASEYGEYNIQCNGIGPGYIATPQTAPLREIQPDGSRHPFDQFIIAKTPAGRWGEAEDLGGPAVFLASEASNFVNGLVLYVDGGILAYIGKQPK

SEQ ID NO: 1326 - protein, 253 aa, Artificial Sequence
  Synthetic
MKRLKGKTALITGGNSGVGEATAMLFAREGADVVITARRGEQLKIVAEKIKAEGGSVLAIRGDVSNPDDSEMLVSRTLETFGKIDILVNNAGVRDEGLRPVDKVTDSEIDRVVGINTKGVMYCTRAVLKDMLKNKKGVIINVASSAGLSGGGGAAYVASKAAILGITKHTAIRCAKSGVRCNALCPSMIKTPMADTTGEIMDSDMMESVMAHSDLTLPVCSAQDVANSILFFASDEAAPITGQCVALDYGSNL

SEQ ID NO: 1327 - protein, 247 aa, Artificial Sequence
  Synthetic
MNDNKVALITGGSRGIGEKIAERFAQAGYNLIINYVSNIENVEELEAKIKGNANIEILFIQSDVTSFESCENMVNEAIKKFGHIDVLVNNAGITKDTLLMRMKEEDFDKVINVNLKGTYNVTKNVIPYMMKQKYGKIINISSVVGVSGNAGQANYAASKAGIIGFTKSVAKELASRNILANCVAPGFIKTDMTDVLSDSVKESINSQIPLKKMGTAEEVANAVYFLGNEENTYITGQVLNVDGGMLM

SEQ ID NO: 1328 - protein, 239 aa, Artificial Sequence
  Synthetic
MDLNHANALVTGGSDGYGRGIAKVLRDAGANVWITGRNAAKLSKTAAELGVRAIQADVSSGSDWDRVINKTGDLDILINNAGNGGRIVPVAEQTDDDIIRTINVNLTGAILGCRRVGASMAKRGRGIILNISSVCALYAWPSWSVYTAAKAGLSKFSHGLYTELRPFGVRVTCVTPSWGQTGFNQAANIRGASEDPALAAKCIAPEELGAIIRSIIEQPDHLAVPDITVQPVIQDISPM

SEQ ID NO: 1329 - protein, 268 aa, Artificial Sequence
  Synthetic
MKTAVVTGASGGIGLETARALLADGWQVVCLSRHACPLEGVRSISCDITDRAQVQAAFAAVDRVDLLVNNAGFGISGAVECTGEAEMRRQFDLNFFAWVTVIQAALPALRESRGRILNISSAAAVFSIPFQSFYSATKAAVESLTCALRSELAPFGITVGALRLGDVKTGFTAARQKSGSGDDLYAGRIARSVAVMERDEQNGMPPAAIATAVVRAAHKKRLPPVTTVGIKYKLLCGLNKLLPLSAVTALVAKIYIPEKQAPSLHRGD

SEQ ID NO: 1330 - protein, 253 aa, Artificial Sequence
  Synthetic
LVTAVITGASSGLGKEYINAIIAEYPTVDVFWLVARRKELLKEIADEHPDKTIAAISLDLSQEESLEIFEKLLKENEPEIKVLVNNAGFGKCGDFFTSNRASQTGMVDVNCRALTAITRLCLPYMLDDSLVINVASIAAFAPTPRMSVYSATKAYVLALSKALHDELRPRGIKVLAVCPGPMDTDFWNVAGVPEGKSRLIDKLPREDPREVAEKSLRAAKRGKMVYAKSAVYKFYHVLSKVLPHGLLMEFTEV

SEQ ID NO: 1331 - protein, 247 aa, Artificial Sequence
  Synthetic
MKALITGASSGIGRDIAKELSQKGYDLILVARNLEKLNEVKEKLETNIETVSMDISNPENCKQLYEKYKDIDILVNNAGFGDCGYFDKTNLEKELQMINTNIVAYHVLTKLYLKDMKAKNSGKILNVASIAGFMPGPLMATYYSTKAYVVRLSEAIREELKKESSKVQISILCPGPVDTNFNKVADVQFALKGLSSEYVAKYTTDKLFKGKFYIVPGWKIKLAKFGAKIAPNTLVAKICYNMQKRKI

SEQ ID NO: 1332 - protein, 239 aa, Artificial Sequence
  Synthetic
MHTAFVTGGSRGIGAAIVRALAPRFNVAFTFRSSEREARALEEELAAYGGVKAFFCDITSPDSVREAERAVSERFGGADMLVNCAGVSSRGLLQDVTDEEWRRLFAVNTDGAFYVTRAFLPYMIEKKRGSIVNVSSVWGVKGGAFEAAYSASKAALVGLTLALAKELAPSGITVNAVAPGAVDTDMMKCYSEAELASLAEDIPLGRMAQPDEVASAVAFLLGHGYVTGQVLTVDGGFTL

SEQ ID NO: 1333 - protein, 268 aa, Artificial Sequence
  Synthetic
MADYLNNFSLEGKVALITGASYGIGFAIAKAMAGAGATIVFNDIKQELVDKGLAAYEAEGIKAHGYVCDVTNEEAVNALVAQIEKEVGVIDILVNNAGIIKRIPMCEMSAAEFRQVIDVDLNAPFIVSKAVIPSMIERGHGKIINICSMMSELGRETVSAYAAAKGGLKMLTRNICSEYGQYNIQCNGIGPGYIETPQTAPLRERQPDGSRHPFDQFICAKTPANRWLKPEELAGPAVFLASEASDAVNGHILYVDGGILAYIGKQPQ

SEQ ID NO: 1334 - protein, 253 aa, Artificial Sequence
  Synthetic
MKRKTALITGATSGIGMACARRFAVGGYNLIITGRSADKLQVLKAELEAGGVEVLALAFDVCNREATRDAVASIPDAFKPIDVLINNAGLARGLEPEYEGDFQDWDEMIDTNIKGLLNMTRFVVPGMVSLNHGHVINIGSVAGDAAYAGGGVYCATKAAVKALTDGLRIDVAHTSVRVTNLKPGLVETNFSNVRFHGDNERADNVYKGIKPLVGDDIADVAFYAASAPEHVQIAEVLVLATHQANGTVVHRKS

SEQ ID NO: 1335 - protein, 247 aa, Artificial Sequence
  Synthetic
MLLEGKIALVTGASRGIGRQIALTLAKEGAVVIVNYNGSAAKAEEVVREITEAGGTAEAVQCSVSDYAKTEEMMKDLIARYKRIDILVNNAGITKDNLLMKMNEEEYDAVLDTNLKGTFNCIKHISRQMLKQKGGRIINISSVSGVMGNAGQANYCASKAGVIGLTKSVARELGSRGITVNAIAPGFIDTEMTAVLPEDVKKAMGDQIPMKKFGKTEDVANLAAFLASDQAGYITGQVINVDGGMAM

SEQ ID NO: 1336 - protein, 239 aa, Artificial Sequence
  Synthetic
MELNHANALVTGGSDGYGRGIAKILGSAGANVWITGRDADKLNRTAAELGVHAIQADVSSGSDWDRVMNETGDLDILVNNAGNGGRIVPVREQTDEDIIRTININLTGAILGCRRAGAVMAKRGHGIILNISSVCALYAWPSWSVYTAAKAGLSKFSHGLYTELRPFGVRVTCVTPSWGQTGFNQAANIRGASEDPALAARCIAPEELGIIIRSIIEQPDHLAVPDITVQPMIQDITPM

SEQ ID NO: 1337 - protein, 268 aa, Artificial Sequence
  Synthetic
MTENILNTFSLEGKIALVTGATYGIGFALASSYAKAGATIVFNDINQEAVDRGMVAYQEAGITAHGYVCDVTDEAGINAMVEQIEKEVGIIDILVNNAGIIKRTPMIEMSAADFRQVIDIDLNGPFIVSKAVIPGMMKKGGGKIINICSMMSELGRETVSAYAAAKGGLKMLTKNIASEYGKYNIQCNGIGPGYIATPQTAPLRELQEDGSRHPFDSFIIAKTPAERWGEAEDLEGPAVFLASKASDFVNGHILYVDGGILAYIGKQP

SEQ ID NO: 1338 - protein, 253 aa, Artificial Sequence
  Synthetic
MKQLNEKVAIVTGAGQGIGKGIALCLAKRGVKVIATGRRVEPIEQTIAEIKELGGEGFAMTCDSADRARVEEVVKAAAEKYGTVDVVVNNAQAIVPSAPVEETSYDNMLKAWQSGVIGSLNYMQAAFPYMKEQHEGRIINFASATGMFGIAGQLAYGSNKEALRGMTKIAAKEWGQYGICVNIVLPGAESPAAKAWAEKFPEEYAKQVNLNPMKRFGDPEIDIAPVIAFLAGPDSCYFSGQSVIVDGANSIMP

SEQ ID NO: 1339 - protein, 247 aa, Artificial Sequence
  Synthetic
MLLENKIAVVTGAGRGIGRGIALALAREGAMVVVNYNGSKERAEEVVRTIEEAGGKAAAIQCNISDFEAAKEFFANVVKEYGKIDILVNNAGITKDNLMMKMSEEEFQSVIQTNLAGTFHGVKFVTRPMMKQRQGRIINIASVSGVIGNMGQANYSASKAGVIGLTKAAAKELASRNITVNAVAPGFVATEMTDVLSDSVKEAAVATIPLGRFGEVEDIAETVVFLASDKAKYITGQVICVDGGIAI

SEQ ID NO: 1340 - protein, 239 aa, Artificial Sequence
  Synthetic
MKTVLVTGGSRGIGKAIVKEFAKNNYNVILNYNKSYEAAKEVENEYKNVKIFRADVSNPKDVQQMIAFANEQFGKIDILVNNAGIGCTGLMQDLSYDEWQNVFNVNVNGIFNLTKQILPEMIANHSGKIINISSIWGMVGASCEVAYSASKAAIIGFTKALAKEVGPSGITVNSVAPGIVMTDMVSAYSVEEFDNIRNQIPLGEIGTTEDIANAVYFLASDKANYITGQVLSPNGGWII

SEQ ID NO: 1341 - protein, 268 aa, Artificial Sequence
  Synthetic
MDRIMDKFSLAGKTALVTGGCYGIGFAIATALHSAGARVVFCATSDASVEKALKAYEAEGITDVKGYACDVTNEEKVKALIAGIEKDVAPLDILVNNAGIIKRIPMCDMDVEDFRRVVDVDLVAPFIVSKAVLPGMVERGHGKIINVCSILSAVGRETVAAYTAAKGGLKLLTQNICSEFGGRNIQCNGIGPGYIATQQTAPLRERQPDGSRHPFDQFIVGRTPAGRWGEPEDLMGPAVFLASDASNFVNGQVLYVDGGVLAYIGKQP

SEQ ID NO: 1342 - protein, 253 aa, Artificial Sequence
  Synthetic
MGRLDGKVCIVTGASAGIGRATAELFCREGAKVVAVARREERLKELAEECKDLPGELVWYAGDVGDPAAAVGMVKKAVETFGRLDVAVNCAGVMDDNTAIADMSDEMLEKTFRINTFGLMYGLREECKQYLAQGDGGVIVNICSVGATHQTAGAAYCASKGAVLAATKNTAFMYMEEGIRCNALSPGGVVTDIPLVMPPADEFGFGRTSKLLDFSGELAMPEDLADAILFLASDQSRYVNGEELKCDGGWTCF

SEQ ID NO: 1343 - protein, 247 aa, Artificial Sequence
  Synthetic
MTVKNKVVVITGASSGIGATTAKQLASNGAKVVLGARREERLAALVDEIKAAGGQAAYQVTDVTKSADVQALVKLAQTQFGGLDVILNNAGIMPTSPISALHTDEWDQMVDINIKGVLNGVAAVMPIFTAQKSGQIITTSSVAGIKSFAGSGVYGATKFAVRNLMEVIRMESAQEGTNIRTVSLYPAAINTELLHTITDKTAKQNMTDFYQQVGISPAAVANVVNFAIDQPEDVNVNEFTIYPTKQA

SEQ ID NO: 1344 - protein, 238 aa, Artificial Sequence
  Synthetic
MKKTILITGASGDIGSEICRFFIKNNYKVIGTYNKNKATIEALAEELGSDFSYYQCDLSDFNNAEKLFKNLGDISIDILVNNSGISVLGLLQDITDSEWIRLWNTNVTSAIAMSKMIIPIFLKQGYGKIINISSVWGQRGASYEVCYSTTKGAIDSFTKALAKELAPSNIQVNAISCGIIDTKMNGHLTQEDVDSIIEEIPASRLGTTEDVANAVYGLVNSGSYVTGQIITVDGGWQV

SEQ ID NO: 1345 - protein, 267 aa, Artificial Sequence
  Synthetic
MGILDNFSLEGKVALVTGASYGIGFAIATAFAEAGATIVFNDIRQELVDKGLASYEEKGIKAHGYVCDVTNEEQVEAMVAQIEKEVGTIDILVNNAGIIKRIPMLEMKASEFRQVIDVDLNAPFIVSKAVIPGMIKKGHGKIINICSMMSELGRETVSAYAAAKGGLKMLTKNIASEYGEHNIQCNGIGPGYIATPQTAPLREIQPDGSRHPFDQFIIAKTPAARWGTAEDLQGTAVFLASDASNFVNGHVVYVDGGILAYIGKQPQ

SEQ ID NO: 1346 - protein, 253 aa, Artificial Sequence
  Synthetic
MRIFITGASSGIGAEMAKIFAARGDTVGLVGRSEEKLESVLAALPAGEHRLYALDVTDRKALIDAAADFEAHGPTDTVIANAGISIGVKTEYYEDLDVLERIYRTNVFAMACTFHAFIDPMRRRGRGHFVGTGSVAGIRGLPGSEAYCSSKAAVISYLESLRNDVRPYGIDVTTISPGFVKTPLTAKNPYKMPFLLEADEFARRAVKAIDAHVSYRTIPWQMGVLSKILRLLPNAVFDKAVAGRGEKPRAKDL

SEQ ID NO: 1347 - protein, 247 aa, Artificial Sequence
  Synthetic
MENIEKTALVTGASRGIGRAIALALASKGFAVALNYAGSHDAAEAVKKEIEDAGGKAFTVQGDVSKSEDVDRIFKTVKDEFGGLDVLVNNAGINRDALLIRMKESNWDDVISTDLKSDFLTTKAAAAMMMRKRKGSIINISSVVGIMGNIGQANYAAAKAGVIGLTKACAKEMAARNIRVNAVAPGFIETAMTDGIPEKIREGMIASIPMGRMGQPEDIARAVCFLASDDASYITGQVLVVDGGLVM

SEQ ID NO: 1348 - protein, 238 aa, Artificial Sequence
  Synthetic
MQGKNILVTGASSGIGKETALYLAKQGATVVLVARNETRLKEVKNAIGEHVYSYICDLNQLESIKGIFEFCKEKGLKLDGMVHAAGISNPIPVRSVSVESMQETMRVNCMSFAELGKYFCGKKYSNENASIVAISSLAATRPVMGQLTYAASKSALNSMVEVMAKEFLKRKIRVNAIMPSYVDTPMVAEGGRFGMNNGIDAMPLGVIEPIQIAYLAEFLLSDKSKHITGAAIPVSSGV

SEQ ID NO: 1349 - protein, 267 aa, Artificial Sequence
  Synthetic
MSEFTNFSLEGKVALVTGASYGIGFAIASAYAECGATICFNDIKQELVDKGIAAYAEKGIKAHGYVCDVTNEEAVNAMVAQIEKEVGTIDILVNNAGIIKRIPMTEMTADQFRQVIDVDLNAPFIVSKAVIPAMIKKGHGKIINICSMMSELGRETVSAYAAAKGGLKMLTKNICSEYGQYNIQCNGLGPGYIETPQTAPLRETQPDGSRHPFDQFICAKTPANRWLKPEELTGPAVFLASEASNAVNGHILYVDGGILAYIGKQPQ

SEQ ID NO: 1350 - protein, 253 aa, Artificial Sequence
  Synthetic
MGRLEGKVCIVTGASAGIGRATAELFCREGAKVVAVARREERLKELAEECKDAPGEMVLYAGDVGDPAVAVGMVKKAVETFGKLNVAVNCAGVMDDNTAIADMSDEMLEKTFRINTFGLMYGLREECKQYLAQGDGGVIVNICSVGATHQTAGAAYCASKGAVLAATKNTAFMYMEEGIRCNALSPGGVVTDIPLVMPPSDEFGFGRTSKLLEFSGELAMPEDLADAILFLASDQSRYVNGEELKCDGGWTCF

SEQ ID NO: 1351 - protein, 247 aa, Artificial Sequence
  Synthetic
MTVKDKVVVITGASSGIGAATAKQLASHGAKVVLGARREDRLAALVDEIKAAGGQAAYQVTDVTKAAEVETLVDLAQTKFGGLDVIFNNAGIMPTSPISALHTDEWDQMIDINIKGVLNGVAAVMPIFTAQKSGQIITTSSVAGIKSFTGAGVYGATKFAVRNLMEVIRMESAQEGTNIRTVSLYPAAINTELLHTITDKTAKQNMTAFYQQVGISPEAVANVVNFAIDQPEDVNVNEFTIYPTKQA

SEQ ID NO: 1352 - protein, 238 aa, Artificial Sequence
  Synthetic
VRTALITGGSRGIGAAAVRAFARAGFRAAFFYRADEAAAQTVARETGAAAIRCDVSDPDRVRKACAEAEKTLGHIDALVNNAGIAQQKLLTDITDEDWRRMLDVNLSGAFYVTRAVLPGMISLKSGSIVNVSSVWGQVGASCEVHYSAAKAGLIGLTRALAKEVGPSGVTVNCVCPGVIQTDMLGDFTGSDLAALAEETPLGRLGTPQEVAAAILWLCQGDAAFVTGQVIGVGGGFGA

SEQ ID NO: 1353 - protein, 267 aa, Artificial Sequence
  Synthetic
MDFSKLFSLEGKVALVTGAAYGIGFSIAEAYAKAGAKIAFNCRSQHHMDQALADYKAKGIDAKGYICDVTDEEQVKNMVADIEKELGVIDILVNNAGIIKRIPMTEMSVEDFKQVIDIDLNAPFIVSKAVLPGMIKKGHGKIINICSMMSELGRETVSAYAAAKGGLKMLTRNICSEFGEYNIQCNGLGPGYIATPQTAPLRERQADGSRHPFDSFICAKTPAGRWLEPEELMGPAVFLASEASNAVNGHILYVDGGILAYIGKQPK

SEQ ID NO: 1354 - protein, 253 aa, Artificial Sequence
  Synthetic
MGRLDGKVCIVTGASAGIGRATAELFCREGAKVVAVARREERLKELAEECKDAPGEMTWYAGDVGEPATAVGMVKKAVETFGKLDVAVNDAGIMDDNTAIADLSDEMLQETFRVNTFGLMYGMREECRQYLAQNGGGVIVNICSVGATHQTSGAAYCASKGAVLAATKNTAFMYMEEGIRCNAVSPGGVVTDIPLVMPPSDEFGFGRTSKLLDFSGELAMPEDLADAILFLASDQSRYVNGEELKCDGGWTCF

SEQ ID NO: 1355 - protein, 247 aa, Artificial Sequence
  Synthetic
MTLVGKVALVTGGSRGIGRAIALKLAENGADVAINYAGNTAAAEEVKTAIEQMGRKALLVQGSVADTDGVQTIVNTVVKELGRLDILINNAGITRDGLLMRMKEADWDDVMHTNLKGVYNCSKAVLRTMMKQRSGRIVNMASVVGEMGNAGQTNYAAAKAGVIGFTKSLAKEVASRGITVNAIAPGFIATDMTSVLTDDQKAEMARTIPLGRAGQPEDVANAVLFLVSEGAAYITGQVLNVDGGMVM

SEQ ID NO: 1356 - protein, 238 aa, Artificial Sequence
  Synthetic
MQGKNILVTGASSGIGKETALYLAKQGATVILTARNEARLEEVKKAMGEHVYSYVCNLNELENVQAIFEFCKEKDLKLDGMVHAAGISSPIPVRSVSVESMEETMHVNCMSFAELGKYFCSKKYSNENAAIVAISSLAATRPVMGQLTYAASKSALNTMVEVMAKEFLKRKIRVNAIMPSYVDTPMVAEGGCFGMNNGIDAMPLGVIEPIQIAYLAEFLLSEKSKHITGAAIPVSSGV

SEQ ID NO: 1357 - protein, 267 aa, Artificial Sequence
  Synthetic
MDYLSNMFSLKGNVALVTGGSYGIGFAIAKALARAGAVIAFNCRIQEHLDQAMKDYEKEGIKAHGYICDVTDELHVQKLVSEIEKTLGTIDILVNNAGIIKRIPMCDMTTEEFRQVIDIDLVGPFIVSKAVIPGMIRKGHGKIINICSMMSELGRETVSAYAAAKGGLKMLTRNICSEFGGANIQCNGIGPGYIATPQTAPLREKQPDGSRHPFDQFIVSKTPAGRWGTTEDLEGPAVFLASHASDFVNGHILYVDGGILAYIGKQP

SEQ ID NO: 1358 - protein, 253 aa, Artificial Sequence
  Synthetic
MKGKTILITGATSGIGEGCARKFGSMGSNLILNGRNVEKLEKLKQELTAQGCEVLTLPFDVRDREAMKQALDSLQGKWRNIDVLINNAGLVIGLDKEQEGSLDEWDVVIDTNIKGLLAMTRMVVPGMVERQCGHIINIGSVAGDAAYAGGSVYCATKAAVKALSDGLRIDLVDTPLRVTNIKPGLVETNFSVVRFRGDKEKADAVYKGIRPLTGDDIAEVVYYAASAPAHVQIAEVLVMPTFQANGTVCHRKA

SEQ ID NO: 1359 - protein, 247 aa, Artificial Sequence
  Synthetic
MDRYVIVTGSSRGIGRTIAIEFSKRGYNVALNCRDPGKLDEGEAAAELCRANGVKAACYLADVCNGEECLKLIKSSGDELGQLAVIVNNAGVIQMRMPFTQLSEDEFERIMRGNVRSVFNMMKTGAEEMKKKRFGRIINIASAAGMYSNSGSIAYSASKAAVISMTVTAAKELGSYGITVNAVAPGFVESAAVQSASEAQKRALLSTLTIKRFAKPEEIAGAVCYLASDNAGYITGTVSEISGLITV

SEQ ID NO: 1360 - protein, 238 aa, Artificial Sequence
  Synthetic
MFTNKVAVVTGGAKGIGRAIVQEFRKAGAAVCVIDLLPNEYFVGDVSDKAALETFARKVIAEHGHVDYLINNALPLMKGIDECSWEEFNYALRVGVTAPFYLTKLFAPHFAPGASVVNISSSRDRMSQPQTESYTAAKGGISALTHAMAVSLAGKVRVNSISPGWIETGDTVWTGPDADQQPAGRVGNPLDIANMVLFLCSDKAGFITGENICIDGGMTRQMIYHNDFGWTFEGGDNA

SEQ ID NO: 1361 - protein, 267 aa, Artificial Sequence
  Synthetic
MDFNKLFSLEGKVALVTGAAYGIGFAMAEAYAKAGAKIAFNCRSQHHMDQALADYKAKGIEAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLEPEELAGPAVFLASDASNAVNGHILYVDGGILAYIGKQPK

SEQ ID NO: 1362 - protein, 253 aa, Artificial Sequence
  Synthetic
MKGKTILITGATSGIGEGCARKFGSMGSNLILNGRNVEKLEKMKQELVAQGCEVLTLPFDVRDREAMKQALDSLQGKWKNIDVLVNNAGLVIGLDKEQEGSLDEWDVVIDTNIKGLLAMTRMVVPGMVERQCGHIINIGSVAGDAAYAGGSVYCATKAAVKALSDGLRIDLVDTPLRVTNIKPGLVETNFSVTRFRGDKAKADAVYKGIRPLTGDDIAEVVYYAASAPAHVQIAEVLVIPTYQANGTVCHRKV

SEQ ID NO: 1363 - protein, 247 aa, Artificial Sequence
  Synthetic
MSEQLSTALVTGGSRGIGKAIAETLAKAGYQVYLTYVSKADEAEAVARNIVAAGGKACAFRLDVADAEAVAAFFKERIKDQVELDVLVNNAGITKDGLMLRMKDEDFDRVIQTNLRGAFVCVREAAKIMTRQRHGRIINISSVVGQMGNAGQINYASAKAGLIGLTKSAAKELAGRNVTVNAVAPGFVETDMTASLPDDVRAAYIDAIPLKRLGTPQDIADAVAFLASPGAGYITGQVIAVNGGMYC

SEQ ID NO: 1364 - protein, 238 aa, Artificial Sequence
  Synthetic
VRTALVTGGSRGIGAAAVRAFSQAGFRAAFFYRADEAAAQAVARETGAAPIRCDVSDPDRVRKACREAERTLGHIDALVNNAGIAQQKLLTDITDEDWRRMLDVNLSGAFYVTRAVLPGMIGRKSGSIVNVSSIWGQVGGSCEAHYSAAKAGLIGLTRALAKELGPSGITVNCVCPGVIQTDMLGDFTPGDLKALAGETPLGRLGTPQEVAAAILWLCREEAAFVTGQVIGVGGGFGE

SEQ ID NO: 1365 - protein, 267 aa, Artificial Sequence
  Synthetic
MFEMKDFSLEGKVALITGASYGIGFAIATAYAKAGATIVFNDIKQELVDKGLAAYQEAGIRAHGYVCDVTDEDAVNAFVAKVEEEVGTIDILVNNAGIIKRIPMLEMSAKDFRQVIDIDLNGPFIVSKAVIPGMIKKGHGKIINICSMMSELGRETVSAYAAAKGGLKMLTRNICSEYGEYNIQCNGIGPGYIATPQTAPLREKQPDGSRHPFDQFIVSKTPAARWGEPQDLMGPAVFLASDASNFVNGHVLYVDGGILAYIGKQPE

SEQ ID NO: 1366 - protein, 253 aa, Artificial Sequence
  Synthetic
MKRLENKTAIVTGGNSGIGKATAILFAKEGADLVLCARRKEALDEVAEECRKYGVQVVTVKADVSSHEDCSAVVKAAVDTFGKVDILVNNAGIVDKHRPITECTDEWWNEIIAIDQSSLFYMMKDTIPHMMASGKGSIINVSSIGGVFGNGGISYSAAKSAALAMTKNVAIQLAPNGIRCNAVCPGPTPTPLNTPEKVAEFSIWFAERCAQHMDMSLPESSVEDQANAILFFAEDASAAVTGQYLIVDHGTTL

SEQ ID NO: 1367 - protein, 247 aa, Artificial Sequence
  Synthetic
MHLTGKTAIVTGGSRGIGRAVAIALAEAGASVAIIYAGNTKAAEETKQAIEEKGAQAMVIQCDVSDEKAVADMVKAVKKELGRVDILVNNAGITRDGLLMIMKEEDWQAVLNTNLNGAFHCTKAVSRLMMKQRSGSIINITSVVGETGNAGQANYAAAKAGLIGFTKSVAKELASRNIRCNAVAPGCIATDMTAVLGEDAVDAMVKTIPMGRVAQPEEVAKAVLFLASDDASYITGQTLNVDGGMVM

SEQ ID NO: 1368 - protein, 238 aa, Artificial Sequence
  Synthetic
MRTALITGGSRGIGAAAVRAFTAAGYQTAFFYRSSGGEAAALACETGAVPVRCDVTDSVRVNAGCAQALARLGHIDALVNNAGVAQQKLFTDLTDGDWRLMLDTNLTGAFYVTRAVLPGMISRKAGRIVNISSIWGQVGASCEVHYSAAKAGLIGMTKALAKEVAPSGITVNCVCPGVIETEMLGCFDSDTLEVLREETPVGRLGTPGDVADCLLWLCAEKAGFVTGQIIGVNGGFGE

SEQ ID NO: 1369 - protein, 267 aa, Artificial Sequence
  Synthetic
MDFNKLFSLEGKVALVTGAAYGIGFAIAEAYAKAGAKIAFNCRSQHHMDQALADYKAKGIDAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLDPEELEGPAVFLASDASNAVNGHILYVDGGILAYIGKQPK

SEQ ID NO: 1370 - protein, 253 aa, Artificial Sequence
  Synthetic
MKLEGKSIVVTGASAGMGQAIVTLFAQEGANVIAVARRKERLDALAEALKEEPGKVIPYVGDVSDPAACDGMIDAAVKAFGRLDVLVNNAGIMDDNTAVGDVSDEMIERLFRVNTYGPLYAMRKAVQVFLTQGEDGGNIINITSVGAAHQTAGVAYCASKAAIASATKNTAFMYIDKGIRCNAIAPGGILTDIPLVMPKANKFGFERTGSLLAHSPEMGLPEDIAGAALFLASDESHFVNGTTIVCDGGWTCF

SEQ ID NO: 1371 - protein, 247 aa, Artificial Sequence
  Synthetic
MSLENKTAVVTGASRGIGLAVAKKLASQGANIAILYVGKEEEGENAKKEVEALGVKVGLYYCDVSSFNESKETVEKIIEEFGGIDILVNNAGIVRDKLVLKMEEADFDAVINVNLKGTFNMIKHTYTHFMKKRAGRIVNVASVVGINGNAGQANYSASKAGVIGLTKSVAKELAGRGVTANAVAPGYIITDMTNALSDKVKDAIEASIPMKKRGLPEDVANAISFLCSDDASYITGEVIRVDGGMAM

SEQ ID NO: 1372 - protein, 238 aa, Artificial Sequence
  Synthetic
MNREFNGKRVVITGGCKGIGKSIAELFLEEGANVVVTYCNSEKAAEAMKENCVRYQGRLCIYQMDVSKAEVVYKVMAEIQEKLGGIDILINNAGIIKDSLVYSMNEMEWDQVLRTNLYGTFYTIKSVLYNMIKQREGNIINVASISGLIGVLGQANYCASKFGVVGLTKTLAKELGRKNIRVNAVAPGYVDTDMIKEVKNINGKITSPKDIAYVVKFLASKESKCINGQVIVADDGNI

SEQ ID NO: 1373 - protein, 267 aa, Artificial Sequence
  Synthetic
MKHPQIILVTGASSGFGRVIATQLAAQGHIVYGSSRKAVSNNPGFKMLQLDITDPASVSNAISTILEEQGSIDVLVNNAGMGISGAIELTTEEEIQRQMNTNFTGAVRMCAAVLPFMREAGHGRIINISSIAGVLAVPFQAFYSASKFAIEGYSEALYQEVKPLGIQVCVVEPGDFQTGFTAQRQVSQTTLSHPQYEESFAKAMRNVELSENNGCRPEKLGKAICKLVNSRRPTFRTKVGPWEQVFFARIKPMLPFSLVDWLIRKFY

SEQ ID NO: 1374 - protein, 253 aa, Artificial Sequence
  Synthetic
MTKTVLVTGATSGIGEACVRRFAKEGYRVIIAGRNRNKLTDLGKKLMEDGVEVLGLEFDVRDHIAAEKAINSMPEEWKDIDVLVNNAGLALSLDKEYELSIEEMETMVDTNIKGLFFMTKLIVPGMVRRNKGHVINIGSLAGDGAYAGGSVYCATKAAVKILSDGLRIDVADTKIRVTDVKPGLVETNFSNVRFHGDKAKADNVYKGITPLSGDDIADVVFYAANAPEHVQIAEVLVTATHQANSYVVARNNQ

SEQ ID NO: 1375 - protein, 247 aa, Artificial Sequence
  Synthetic
MHLTGKTAIVTGGSRGIGRAVALALAEAGASVAIIYAGNTKAAEETKQAVEEKGVQAMAIQCDVSDEKAVADMVKAVKKEWGRVDILVNNAGITRDGLLMIMKEEDWQAVLNTNLNGAFHCTKAVSRLMMKQRSGSIINITSVVGETGNAGQANYAAAKAGLIGFTKSVAKELASRNIRCNAVAPGCIATDMTAVLGEEAVDAMVKTIPMGRVAQPEEVAKAVLFLASDDASYITGQTLNVDGGMVM

SEQ ID NO: 1376 - protein, 238 aa, Artificial Sequence
  Synthetic
MKKVLLTGASGGIGAALARRLAREGYELVLVCSRTEDKLLRLKMELEQKYGCCCEAEICDVSQPEQVEALFLETGEIDILINNAAVSYVGLLTDMSVEEWQQVIDTNLNAVFYTCKEAVPGMVRKKTGKIINVSSVWGSAGASMEVAYSASKGGVNSFTKALAKELAPSNIQVNAVSFGMIDTQMNACFSKEEKQAIIEEIPADRLGTPEEAADMIWQVLQSPAYFTGQIVTMDGGWI

SEQ ID NO: 1377 - protein, 267 aa, Artificial Sequence
  Synthetic
MNPYLNFSLEGKVALVTGASYGIGFAIASAFAEQGATICFNDINQELVDKGLAAYTEKGIKARGYVCDVTDEPAVQAMVAQIEKEVGSVDILVNNAGIIRRVPMHEMEAADFRRVIDIDLNAPFIVSKAVLPAMMKKGHGKIINICSMMSELGRETVSAYAAAKGGLKMLTRNICSEYGEYNIQCNGIGPGYIATPQTAPLREKQADGSRHPFDSFICAKTPAGRWLAPEELTGPAVFLASEASNAVNGHILYVDGGILAYIGKQPK

SEQ ID NO: 1378 - protein, 253 aa, Artificial Sequence
  Synthetic
MKGKLVFITGATSGIGEGCARKFAAMGSNLILNGRNVEKLESLKKELTAQGVEVLTLPFDVRDRQAMRQAVDSLQDKWRHIDVLINNAGLVIGMDKEYEGSLEEWDVVIDTNIKALLAMTRMIVPGMVERGCGHIINIGSVAGDAAYAGGSVYCATKAAVKALSDGLRIDLVDTPLRVTNIKPGLVETNFSVVRFRGDKGKADAVYEGIRPLTGEDVAEVVYYAASAPAHIQIAEVLVMPTYQATGTVCYRKK

SEQ ID NO: 1379 - protein, 247 aa, Artificial Sequence
  Synthetic
MSDLIGKVALVTGASRGIGKAIAKELAQNGASVIINYSKDDEGANSTLKEIRELGGYAKVIKKDISIKDQCEELIKEIIETFGKIDILINNAAKSEVGLFMDVDDKSFEKLINTNLLAPMYLSKYALNYMISKGCGNIINISSIWGEAGASCEVVYSTTKGGLNLFTKSLSKEVAPFGIRVNSIAPGVINTEMNNFLSEEEKNQLIDEIPMNRFGDVKEIAKAVVFLCKDDCKYLTGQIIRIDGGFL

SEQ ID NO: 1380 - protein, 238 aa, Artificial Sequence
  Synthetic
MNKEFNGKKVVITGGCKGIGKSIAELFLEEGANVVVTYCNSEKAAEAMKENCVRYQDRLSIYKMDVSKAEVVYKVMAEIQEKLGGIDVLINNAGIIKDSLVYSMNEMEWDQVLRTNLYGTFYTIKSVLYNLIKQREGNIINIASISGLTGILGQANYCASKFGVIGLTKTLAKELGKKNIRVNAVAPGYVDTDMIKGVKNINGKITSPKDIAYVVKFLASKESKCINGQVIVADDGNI

SEQ ID NO: 1381 - protein, 267 aa, Artificial Sequence
  Synthetic
MKDLNAFSLEGKVALVTGASYGIGFAIASAMAAAGATIVFNDIKQELVDKGVAAYEEAGIKAHGYVCNVCDEDAVNAMVAQIEKEVGVIDILVNNAGIIKRIPMIEMSAADFRQVIDVDLNAPFIVAKAVIPSMIKKGGGKIINICSMMSEFGRETVSAYAAAKGGLKMLTRNIASEYGEYNIQCNGIGPGYIATPQTAPLREIQPDGSRHPFDQFIIAKTPAGRWGEAEDLGGPAVFLASEASNFVNGLILYVDGGIHAYIGKQPS

SEQ ID NO: 1382 - protein, 253 aa, Artificial Sequence
  Synthetic
MKALITGASSGIGRDIATELAQRGYDLILVARNIEKLNQVKENILNNCNNINIKIIQMDVSTPENCKNLYNQVNDDIDILINNAGFGVFGDFTKTNIDKEIQLINTNITAVHILTKLFLQDMEKKNKGHILNVASIAGFMPGPLMATYYSSKAYVVRLSEAIREELRRKKSNVKLSILCPGPVNTNFNNVADVNFKAKSLSSEYVAKYAVNEMLKGKFYIVPGAQIKCLRFIAKIVPNNIIAKFAYKVQERKK

SEQ ID NO: 1383 - protein, 247 aa, Artificial Sequence
  Synthetic
MLKDKNIIVTGATRGIGKEIALTLAQNGANIAINYRNYNEEVEELINSIKEFGVDAIAVKCDVSKSDEVDNFISEVKNHFSSIDVLVNNAGITKDGLLLRMKDEDFNSVLDVNLKGTFNTTKSISPIMIKQKHGKIINISSVVGIVGNAGQCNYAASKAGVIGFSKSVARELASRNINVNVVAPGYIDTDMTKSLPDKVKDEILKSIPMKKMGNPKEVANLVLFLSSSLSDYITGQVINVDGGMVMA

SEQ ID NO: 1384 - protein, 238 aa, Artificial Sequence
  Synthetic
VSLITGGNRGIGRAIALRLASEGSSIILFGRNEKDNQSVEKEISSAYGVPVKSYKVDMSSRKSVEEGVEKAVSHFHRIDVLINNAGICRLSTPFAEVKEEDWKETLSINLYGVIYVTGLVIPYLEKEGGKIVNIASLAGEVGGIATSADYVASKAALQGITKSLARELGVKHINVNAIAPGFVRTQMTEKMSIQLSSIPLRQVAEPEDIAAAAAFLASDDARLITGTTLDVNGGLYMN

SEQ ID NO: 1385 - protein, 267 aa, Artificial Sequence
  Synthetic
MANTNPFSLEGKIALITGASYGIGFAIAKSMAAAGATIVFNDIKQELVDKGIAAYKEEGIDAHGYVCDVTNEEAVNALVATIEKEVGVIDILVNNAGIIKRIPMCDMTAAEFRQVIDVDLNAPFIVSKAVIPSMIKKGHGKIINICSMMSELGRETVSAYAAAKGGLKMLTKNICSEYGEYNIQCNGIGPGYIETPQTAPLRERQPDGSRHPFDSFIISKTPAGRWLQADELGGPAVFLASDASNAVNGHILYVDGGILAYIGKQPN

SEQ ID NO: 1386 - protein, 253 aa, Artificial Sequence
  Synthetic
MGLVEGKVIIVTGASSGIGEKTAEVLAAEGAKVVLAARRKEKLEDVANRIIAAGGEAYTVSGDVSVREDCDRIADETVKKYGRIDVLVNNAGIGDKQMSITRCSDDWWRQIIAVNQDSVFYMSRAALVYMEKRGEGSIVNISSIGGVFANAGIAYSAAKAAVVAMTKNVAIQFAGKGIRCNAVCPGPTITPLLSSDEIATFDQEFMKTCNEHICRSVPKAEAVDQANAILYFASDLSKAVTGQALVVDYGCNL

SEQ ID NO: 1387 - protein, 247 aa, Artificial Sequence
  Synthetic
MYYELDNKVILVTGASRGLGRDIAKKLALNNASIIINYKSSVGEASKLYSEIKQFNSKCITYLADVTDEKQVKKMYMDVIKEYGKIDVLINNAGLCSDNFIQFMSYDQWDRVIKNSLYGVFLCSRIFSKCLIKNGGGKIINIASLKGQLGSEGQCNYSAAKAGVIGLTKALAKEFGPYNISVNAVCPGFAVTDLNKDNENKVMYAMEMSTMTTEYTKSDLSNFIAFLCSDAIKGVSGRIFNLDSRIM

SEQ ID NO: 1388 - protein, 238 aa, Artificial Sequence
  Synthetic
MDFSKLFSLEGKVALVTGAAYGIGFSIAEAYAKAGAKIAFNCRSQHHMDQALADYKAKGIDAKGYICDVTDEEQVKNMVADIEKELGVIDILVNNAGIIKRIPMTEMSVEDFKQVIDIDLNAPFIVSKAVLPGMIKKGHGKIINICSEFGEYNIQCNGLGPGYIATPQTAPLRERQADGSRHPFDSFICAKTPAGRWLEPEELMGPAVFLASEASNAVNGHILYVDGGILAYIGKQPK

SEQ ID NO: 1389 - protein, 267 aa, Artificial Sequence
  Synthetic
MSFLNNFSLEGKIALVTGASYGIGFAIASAYAEAGATIVFNDIKQELVDKGLAAYAEKGIKAHGYVCDVTNEEQVNELVKKVEEEVGVIDILVNNAGIIKRIPMCDMSAAEFRQVIDVDLNAPFIVSKAVIPSMIKKGHGKIINICSMMSELGRETVSAYAAAKGGLKMLTKNIASEYGEFNIQCNGIGPGYIATPQTAPLREIQPDGSRHPFDQFIIAKTPAARWGNAEDLQGPAVFLASDASNFVNGHVLYVDGGILAYIGKQPQ

SEQ ID NO: 1390 - protein, 253 aa, Artificial Sequence
  Synthetic
MKGKLVFITGATSGIGEGCARKFAAMGSNLILNGRNIEKLESLKQELAAQGVEVLTLPFDVRNREAMRQAVDSLEGKWKEIDVLVNNAGLVIGMDKEHEGSLDEWDVVIDTNIKALLAMTRMIVPGMVARGCGHIINIGSIAGDAAYAGGSVYCATKAAVKALSDGLRIDLVDTPLRVTNVKPGMVETNFSVVRFRGDKEKADAVYEGIRPLTGDDIAEVVYYAASAPAHVQIAEVLVMPTYQATGTICSRKK

SEQ ID NO: 1391 - protein, 247 aa, Artificial Sequence
  Synthetic
MLKGKNVIVTGATRGIGKEIALTLAQNGANIAINYRNYNDEIVELINALKEFGADVLAIKCDVSKSNEVENFVSEIKNHFSSIDILVNNAGITKDGLILRMKDQDFDDVLNVNLKGTFNTTKFVSQVMFKQKHGKIVNISSVVGLIGNAGQSNYSASKAGVIGFSKSVAKELASRNININVVAPGYIDTDMTKSLPDRVKEEILKSIPMKKIGNPKEVANLVLFLSSNLSDYITGQVINVDGGMVMA

SEQ ID NO: 1392 - protein, 237 aa, Artificial Sequence
  Synthetic
MSIEGKKIIITGGATGYGYGDARALKAAGGEVWIVGRRLERLRKAAEELGVRFIQGDITRGEDWDRIMETVGEVDILVNNAGIAVKVEPLLSFSDEEIFRSINGNLTGAILGCRRVAEKMVARKSGLIINVTSVCSHYGWPGFACYTAAKAGLDMFSRALYTELRPHNVRVTVLTPSWGATEFGIAANLPPTGKELAAKMMSPDQMGELVRYICDFPEHLEFPEIMVQPLVQEIIPF

SEQ ID NO: 1393 - protein, 267 aa, Artificial Sequence
  Synthetic
MDFNKLFSLEGKVALVTGAAYGIGFAIAEAYAKAGAKIAFNCRSQHHMDQALADYKAKGIEAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLDPEELEGPAVFLASDASNAVNGHILYVDGGILAYIGKQPK

SEQ ID NO: 1394 - protein, 253 aa, Artificial Sequence
  Synthetic
MRFEGKSVVVTGASSGMGRKIALDFAKEGAAVIAVARRKERLEELAKEAEGLAGKILPYPGDVSTQEVNEGMIDYAVSECGKLDVLVNNAGVMDEFTPIGELSNELWDKVMKVNLEGPVYAMRKAVQVMAKQETAGNIVNVASIGGVCGCRAGAAYTASKHALVGVTKNTAYMYAGDKIRCNVICPGGVETEVMVGQTNISQMGMGRIMAGLDSSIPQGQPEDISSAVLFVASDEAKFMTGAVLVIDGGVSCN

SEQ ID NO: 1395 - protein, 247 aa, Artificial Sequence
  Synthetic
METIEKTALVTGASRGIGRAIALTLAAKGYAVALNYAGSQAAAEAVRGEIEAAGGKAFTIQGDVSKAEDVDRIFKTIKEEFGQLDVLVNNAGITRDGLLIRMKEESWDAVLSTDLKSDFLTIKAAAQMMMRKKKGSIINIASVVGIMGNIGQANYAAAKAGVIGLTKACAKELAARNIRVNAVAPGFIATDMTDAIPEKNKEAMLKAIPLGRMGLAEDVAKAVSFLASDDASYITGQVLKVDGGMVM

SEQ ID NO: 1396 - protein, 237 aa, Artificial Sequence
  Synthetic
VKRVLVTGGSRGIGAAAVRLFAADGRQVIANYCGSEEQARALAAETGCLLCRADVSDSDGRSALLAFADEALGGVDVLVNNAGVALFGLFDALPEDAVQKLYGVNLTGTVELCRLFLPQMLRRKSGCIVNVSSVWGTTGASCEVDYSASKAAVAGLTRALAREVGPSGVRVNCVAPGVIDTDMNGRLTYEEMLALTDEIPLMRLGTAEEAAKAIFFLASEDSAYITGQVLGVDGGFR

SEQ ID NO: 1397 - protein, 267 aa, Artificial Sequence
  Synthetic
MDFSKLFSLEGKVALVTGAAYGIGFAIAEAYAKAGAKIAFNCRSQQHMDQALADYKAKGIDAKGYICDVTDEEQVKKMVADIEKELGVIDILVNNAGIIKRIPMTEMSVADFKQVIDIDLNAPFIVSKAVLPGMIKKGHGKIINICSMMSELGRETVSAYAAAKGGLKMLTRNICSEFGEYNIQCNGLGPGYIATPQTAPLRERQADGSRHPFDSFICAKTPAGRWLEPEELMGPAVFLASDASNAVNGHILYVDGGILAYIGKQPK

SEQ ID NO: 1398 - protein, 253 aa, Artificial Sequence
  Synthetic
MNRLEGKVAVITGCSHGIGLRAAQLFADEGAKVLATSWNMENLEKNLAGYSENIVLFQLDVREEDQWASAAAKAEELWGKIDILVNNAGLSAKCDLLKETLEGWEAGLRMNLTSQFLGIKTVIPYMQKNGKGSIINCSSLTALKGSMDAGAPAYCSAKAGLRALTRHVAYNFAKDNIRCNIVYPGSVYTNAVAKYGVSFEQMAASPFATKFHPLPPYLGEADDMAYAYLYLASDEAKWITGVDFPVDGGANIC

SEQ ID NO: 1399 - protein, 247 aa, Artificial Sequence
  Synthetic
MLLEGKIALVTGASRGIGRQIALTLAKEGAVVIVNYNGSAAKAEEVVKEITEAGGTAEAVQCSVSDYAKTEEMMKDLIARYKRIDILVNNAGITKDNLLMKMSEEEYDAVLDTNLKGTFNCIKHVSRQMLKQKGGRIINISSVSGVMGNAGQANYCASKAGVIGLTKSVARELGSRGITVNAIAPGFIDTEMTAVLPEDVKKSMGEQIPMKKFGKTEDVANLAAFLASDLAGYITGQIIGVDGGMAM

SEQ ID NO: 1400 - protein, 237 aa, Artificial Sequence
  Synthetic
MDKNYLITGGSSGIGMACAKQLVSVGENVVLVSGNEEKLQKVCEELGKRASYIVCDLSDLNNASDVFTETQKRGIIFDGMIYSAGVANPMPIICEEVENVQNMMNVNCLSFLMLGKEFFNRKNSKKGSAIVAISSLAVEYPAKGQSVYAASKAALNMIVKIMAKEFVRRKIRINSIMPSYVDTPMIHDDTKAFMDNGVENLPLGVIDPVQIAALAEFLLSDNAQYMTGASIPVSAGI

SEQ ID NO: 1401 - protein, 267 aa, Artificial Sequence
  Synthetic
MRWAVVTGASSGIGLEFAHQLAERGYSVLMVSNQDNELVEWAEKIHEQYGVATIAHRLDLTDPNATDSIIGVLRANSIVPEVFVNNAGIFDFKKVEELGRRRLNLYIDLHIRAVTMLSTEIAMMMATEAKEGYILNMSSMSCWMPMPGIAMYSATKAYIRAFSRALRVEMKDYGVSVTVACPGGIATSLFGLPEKWRKFAVRIGVLATPHTFVRRALRKMFKRKAQYINGGLNRVSIVAVAMLPEWGRVMIKRIGLDRQGKKENKGK

SEQ ID NO: 1402 - protein, 253 aa, Artificial Sequence
  Synthetic
MKQLNEKVAVVTGAGQGIGKGIALCLAKRGVKVIATGRRLEPIEATIAEIRELGGEGFAMTCDSADRERVFEVVEKAVDTFGSIDVIVNNGQAIVPSQPVEDTEYENMLKAWQSGVIGSLNYMQAAFPYMKEQNEGRIINFASATGMFGIAGQLAYGSNKEALRGLTKIAAKEWGQYGICVNIVLPGAESPAAKAWAEKFPEEYAKQVNLNPMKRFGDPEGDIAPVIAFLAGPDSCYFSGQSVIVDGANSIMP

SEQ ID NO: 1403 - protein, 247 aa, Artificial Sequence
  Synthetic
MQLEGKIALVTGASRGIGKAIAVALAAAGADVAVNYAGNKAAAEAVADEIEGMGRKALLLQGDVAQTAVCAEMIEAVVKEFGRIDILVNNAGITRDTLLMRMKEEDWDAVLNTNLKGVFNCTKAAVKYMMKQRAGRIINISSVVGVMGNAGQANYAAAKAGCIGFTKSVAKEVAARGITVNAVAPGFIKTDMTSVLPEKVVAEMEAGIPLARLGEPEDIAKAVLFLASDDAAYITGQTLHVDGGMVM

SEQ ID NO: 1404 - protein, 237 aa, Artificial Sequence
  Synthetic
MKSYEKTVWITGGSSGYGKAMAQLFLADGFTVIIAAHHGERLEQAAQELGCDSFRMDVTSSADWKKAAAYAQEKYGGIDILINNAGGGVAIRDTVDLTDEDIDRALDLNLKSVIYGSRAFAPMMMRQKRGTIVNISSVCAKQAWPQWTLYASAKWGVLGFSKGLYTELQPYNIRVSCAIPAACGATNFDRSANLPARELLMQPEDFAKAVVETCKLPQHVVVEEITVWGIDQVVVPL

SEQ ID NO: 1405 - protein, 267 aa, Artificial Sequence
  Synthetic
MNQYLNFSLEGKVALVTGASYGIGFAIASAFAEQGAKICFNDINQELVDKGIAAYAEKGIQAHGYVCDVTDEPAVQAMVATIEKEVGSVDILVNNAGIIRRIPMHEMEAADFRKVIDIDLNAPFIVSKAVLPAMMKKGHGKIINICSMMSELGRETVSAYAAAKGGLKMLTRNICSEYGEYNIQCNGIGPGYIATPQTAPLREKQADGSRHPFDSFICAKTPAGRWLDPEELTGPAVFLASEASNAVNGHILYVDGGILAYIGKQPK

SEQ ID NO: 1406 - protein, 253 aa, Artificial Sequence
  Synthetic
MRRLDGKVCIVTGASAGIGRATAELFCREGAKVVAVARREERLKELAEECKDAPGEMTWYAGDVGDPAAAVGMVKKAVETFGKLDVAVNCAGVMDDNTAIADMSDEMLEKTFRINTFGLMYGLREECKQYLAQGDGGVIVNICSVGATHQTSGAAYCASKGAVLAATKNTAFMYMEEGIRCNALSPGGVVTDIPLVMPPSDEFGFGRTSMLLNFSGELAMPEDLADAILFLASDQSRYVNGEELKCDGGWTCF

SEQ ID NO: 1407 - protein, 247 aa, Artificial Sequence
  Synthetic
MEGLERTALVTGASRGIGRAIALALGKAGYAVAVNYAGNRTAAEAVRDEIVSAGGKSFIVQADVSKSEDVDSMFKTVKEEFGFLDVLVNNAGITKDGLLIRMKESAWDEVISTNLKGNFLTLKAAAAMMMRRKQGAIINISSVVGLTGNIGQANYAAAKAGVIGMTKAAAKELAARGIRVNAVAPGCIVTDMTDKIPENIKEGMLHSIPLSRLGQTEEVAKAVLFLASDDASYITGQVLNVDGGMVM

SEQ ID NO: 1408 - protein, 236 aa, Artificial Sequence
  Synthetic
MNFSGKVAMITGATRGIGRAATEIIIANGGKVIATGRNEQVLKELVDEYHDKICTYKCDVSDELSVRQMVADATERMGKIDILINNAGIYMEDKAPFINQTSDIWKKKIDVNIYGTLYPTHEVLPQMIERRWGRIINIASVAGIYGIRDMLDYSLTKGAIIAFTTGLAREVGEYNITVNAVSPGNINTYNELPELSYMNRSGTPTECANVICFLASDEASFVSGSNYVVDGSRKKI

SEQ ID NO: 1409 - protein, 267 aa, Artificial Sequence
  Synthetic
MDFNKLFSLEGKVALVTGAAYGIGFAIAEAYAKAGAKIAFNCRSQHHMDQALADYKAKGIDAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLEPEELEGPAVFLASDASNAVNGHILYVDGGILAYIGKQPK

SEQ ID NO: 1410 - protein, 253 aa, Artificial Sequence
  Synthetic
MRKIALITGATSGLGKAIALRLAKEGYDVIITGRRKDRLEELEREIEIKYESKVYSLCFDVRVYNEVEKAITSLPEEWKAIDILVNNAGLAVGLDPIQQGVIDDWERMIDTNIKGLLYVTRVVSPGMVARKSGHIVNLGSIAGKGVYPNGAVYCATKHAVDALSQGMRMDMLPYGIRVTQVCPGAVNTEFSLVRFKGNQDRADLVYDGYDALTAENIADAVFYAVSQPPHVDIQDMLVMPTAQANGNMFHKNN

SEQ ID NO: 1411 - protein, 247 aa, Artificial Sequence
  Synthetic
MRLEGKVAIVTGAGRGLGRGIARKLAQEGAKVVIADVTPADDAVKELLDAGHEACDFSVDVSDQEQMAALVAFAIKKYGTLDIMVNNAGINRDGMLHKMPRENWDKVIAIDLTGTFFGTQEAIKYMRTKNYGRVINISSGSWLGNIGQANYAAAKAGVVGLTKTAARENARKGITCNAICPGFIETDMTLKLKEVNDGAAWDSMVQRIPMGYAGKPSDVGNLVAFLASDEAAYITSEVINVGGGMIV

SEQ ID NO: 1412 - protein, 236 aa, Artificial Sequence
  Synthetic
MFENKVAVITGGAKGIGKAIAEEFRREGARVCVIDLLENDYYKGDIADQAVLEDFVRKVIGDYGHVDYLINNALPLMKGIDACTYEEFNYALRVGVTAPFYLAKLFAPHFAPGGAIVNISSSRDRMSQPQTESYTAAKGGISALTHALAVSFAGRVRVNAIAPGWIDTDYTVYKGPDAVQQPAGRVGNPMDIANMVLYLCSDKAGFITGENICIDGGMTRQMIYHNDFGWRLEETT

SEQ ID NO: 1413 - protein, 267 aa, Artificial Sequence
  Synthetic
MDFNKLFSLEGKVALVTGAAYGIGFAIAEAYAKAGAKIAFNCRSQHHMDQALADYKAKGIDAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLEPEELEGPAVFLASEASNAVNGHILYVDGGILAYIGKQPK

SEQ ID NO: 1414 - protein, 253 aa, Artificial Sequence
  Synthetic
MKGKTILITGATSGIGEGCARKFAAMGSRLILNGRNIEKLESLKKELEKTGTEVVTLPFDVRNREEMHNAIDSLQGEWKNIDVLINNAGLVLGVDKEHEGSLDEWDVVIDTNIKGLLAMTRMIVPSMVERGCGHIINIGSIAGDAAYAGGSVYCATKAAVKALSDGLRIDLVDTPLRVTNIKPGMVETNFSVIRFRGDKNKADAVYDGLKPLTGDDIADVVYYAASAPAHVQIAEVLVMPTYQATGTVCHRQK

SEQ ID NO: 1415 - protein, 247 aa, Artificial Sequence
  Synthetic
MKKFEAKTVVITGASRGIGKALTDYFVMEGANVVTISRSAEIVKTDKVFPIVSDIEKCEYIEKILAENNIDVDILINNAGIICYENLEQVTRSQIQEVFNTNVISTVLLSQMIMRRMEQQKKRGVIVNTLSFAATIPSAGSGIYAASKAAMTSLTRTMAAEWAPKGIRVNGYSPGVIETEMTKPAIQNNGENMLDAIALHHFGKVDEMVKVVGFLASEDSEYITGINLDASGGKYIVQNAGNAWKEK

SEQ ID NO: 1416 - protein, 236 aa, Artificial Sequence
  Synthetic
MKNVLVTGASKGIGKCIAQVLSKNYNVFVTARTEKALKELSVAGYYICDLEKSTDLAKLKEFIIENKIDILVNNAGEYIYNPIENMDYSHISEIFKINSIAPAFLSSAVVPYMKSQKWGRIVNIGSISGVMGEAFASMYSATKASLIGMTKALALELASENITVNTINPGWVDTELGKDSIESSEFSEDEILECIPQRRFVEPIEVANLVKYLISEEAKGLTGQAINLCAGLSVGI

SEQ ID NO: 1417 - protein, 267 aa, Artificial Sequence
  Synthetic
MSFLNNFSLEGKIALVTGASYGIGFAIASAYAEAGATIVFNDIKQELVDKGLAAYAEKGIKAHGYVCDVTNEEQVNAFIKKVEEEVGVIDILVNNAGIIKRIPMCDMSAAEFRQVIDVDLNAPFIVSKAVIPSMIKKGHGKIINICSMMSELGRETVSAYAAAKGGLKMLTKNIASEYGEFNIQCNGIGPGYIATPQTAPLREIQPDGSRHPFDQFIIAKTPAARWGNAEDLQGPAVFLASDASNFVNGHVLYVDGGILAYIGKQPQ

SEQ ID NO: 1418 - protein, 253 aa, Artificial Sequence
  Synthetic
MRLDGKVAIITGGNSGIGKATALLFAKEGAKVVITARREKQLQKVSEEILTMGGNVLAVASDISNPAECTKVVNETLEKFGKLDILVNNAGILDHGTAAIDSVKDEDINAVIDINAKGTIYFTREVAKVMAEQKSGAIVNTASVAGVVGNGGAAYVASKGAVIALTKNVALRMASIGVRCNAVCPGTVNTPMTSSDNLKNLDMNMLGAIMAHMDKNVPICQPEDVANTILFLASDEAKAITGQIIVTDFGATL

SEQ ID NO: 1419 - protein, 247 aa, Artificial Sequence
  Synthetic
MSMQGKVAVVTGGSRGIGRAVCLELARRGANVVIGYAGDEQAAHVAADACRDAGGKAVIVKADVATAEGSEALFAEAVASFGRVDILVNNAGITRDMLILRMSEQDFDRVLDVNLKGAFFCMKLAARLMSKQRYGRIINMSSVVGLRGNAGQVNYAASKAGLIGMTKSLAKEIASRGVTVNAIAPGFIETDMTRTLLPTVQDSILTSIPLKRFGQPEEVAHAAAFLASEEAGYITGQVLCIDGGMAM

SEQ ID NO: 1420 - protein, 235 aa, Artificial Sequence
  Synthetic
MSTILITGGTGAIGSAIAAEFAATDDVVFTYNSRADEAQRLCGELRCSAVRCDVADYASCEAAAEKVLKDYGRIDVLVNNAGISQIKLFTDITPEDWQRVMNVDLNGVYNMTHAIIRSMINRESGAVVNVSSVWGVYGGACESAYSAAKAGVVGLTKALARELGASGITVNAVAPGVIDSPMNSSHLNPEELRELADQTPVCRLGKPSEVAKAVRALAENRFITGQVLGVDGGFC

SEQ ID NO: 1421 - protein, 267 aa, Artificial Sequence
  Synthetic
MDVMKSFSLEGKVALVTGAAYGIGFAIAEAYAKAGAKIVFNCRGQEHMDVAMKAYEEKGIKAKGYICDVTDEAQVADMVQDIEKTVGTIDILVNNAGIIKRIPMTDMSAEEFRQVIDVDLNAPFIVSKAVIPGMLKKGHGKIINICSMMSELGRETVSAYAAAKGGLKMLTKNIASEYGEFNIQCNGIGPGYIATPQTAPLREIQPDGSRHPFDQFIISKTPAARWGNPEDLMGPAVFLASEASDFVNGQILYVDGGILAYIGKQPK

SEQ ID NO: 1422 - protein, 253 aa, Artificial Sequence
  Synthetic
MGRLDGKVCIVTGASAGIGRATAELFCREGAKVVAVARREERLKELAEECKDAPGEMTWYAGDVGDPAAAVGMVKKAVETFGRLDVAVNCAGVMDDNTAIADMSDEMLEKTFRINTFGLMYGLREECKQYLAQGDGGVIVNICSVGATHQTAGAAYCASKGAVLAATKNTAFMYMEEGIRCNALSPGGVVTDIPLVMPPADEFGFGRTSKLLEFSGELAMPEDLADAILFLASDQSRYVNGEELKCDGGWTCF

SEQ ID NO: 1423 - protein, 247 aa, Artificial Sequence
  Synthetic
MNRLEGKIALITGGTSGMGEAFAKLFAKEKAEVIVVGRNRERGNKVVKEILENGGKACFMECDVTSIDSIRNLRKEVDVKYGKLDILVNNAGILITDEFENTKEKDWMTVFDTNTNAVMWITQKFLDLLIKSHGSILNNASYVGLQTLSRGRTNYAYAASKSATIKLTQQLALNYTPKGIRVNCLCPGIIETPIFTNRDFSRFNSLIPMGRVGTAEEVAKAALFLVSDDSSYISGAILTVDGAASLK

SEQ ID NO: 1424 - protein, 235 aa, Artificial Sequence
  Synthetic
MEYKDKVAVVTGGAHGIGKCIAEEFRKRGASVAVIDVREGDHFVGDISKKEVLEAFADEVIGKYGKVDIIVNNALPLMKGLDECSWEEFQYALAVGVTAPFYLVKLLAPYLAEGASIVNISSSRDRMSQPQTESYTAAKGGIAALTHALAVTLQGKARVNSISPGWIDTDFKEYDGADAVQQPAGRVGNPMDIANMVLFLCSDKAGFITGENICIDGGMTRQMIYHGDYGWTLKE

SEQ ID NO: 1425 - protein, 267 aa, Artificial Sequence
  Synthetic
MDYLSNMFSLKGNVALVTGGSYGIGFAIAKALARAGAVIAFNCRSQEHLDQAMKDYEKEGIEAHGYICDVTDELHVQKLVSEIEKTLGTIDILVNNAGIIKRIPMCDMTTEEFRQVIDIDLVGPFIVSKAVIPGMIRKGHGKIINICSMMSELGRETVSAYAAAKGGLKMLTRNICSEFGGANIQCNGIGPGYIATPQTAPLREKQPDGSRHPFDQFIVSKTPAGRWGTTEDLEGPAVFLASHASDFVNGHILYVDGGILAYIGKQP

SEQ ID NO: 1426 - protein, 253 aa, Artificial Sequence
  Synthetic
MKGKLVFITGATSGIGEGCARKFAAMGSNLILNGRNVEKLESLKKELTAQGVEVLTLPFDVRDRQAMRQAVDSLQGKWQHIDVLINNAGLVIGLDKEYEGSLEEWDVVIDTNIKALLAMTRMIVPGMVERGCGHIINIGSVAGDAAYAGGSVYCATKAAVKALSDGLRIDLVDTPLRVTNVKPGLVETNFSVVRFRGDKGKADAVYEGIRPLTGDDIAEVVYYAASAPAHIQIAEVLVMPTNQATGTICYRKK

SEQ ID NO: 1427 - protein, 247 aa, Artificial Sequence
  Synthetic
MLLQDKTAVVTGGSRGIGRAVAVALAAEGAKVAVIYAGNTSAAGETVGIIEKAGGTAAAMQCDVADEGAVTAMIAAVQEKFGTVDILVNNAGITRDGLLMRMKTADWQSVIDTNLTGMYYCTKGVTKIMMKRRCGVIINMTSVVGQTGNAGQANYAAAKAGVIGFTKSVAKELASRGIRANAVAPGCIDTDMTAVLSDEVKKEMIKAIPLGRTAAPEEVAQAVVFLASDKAGYITGQVLNVDGGMVM

SEQ ID NO: 1428 - protein, 235 aa, Artificial Sequence
  Synthetic
MLCLRYNEGNISSGGYRMRVLITGTSSGIGKAIAEKFLKEGFDVTGFDRKEASISQDLYTHFCLDIRDREQYPALAPFDIVINNAGVQNENDIDINLKGTIAITEAYGIHDTIRAVLMIGSASGHTGAEFPEYTASKGGVLAYTKNVALRIAPYGGTCNSLDFGGVLTELNLPVTEDQKLWDQIMDLTPLKRWMTVEETADWAYFMTVTNRFCTGQNILIDGLEAGNAHFVWPDE

SEQ ID NO: 1429 - protein, 267 aa, Artificial Sequence
  Synthetic
MKHPQIILVTGASSGFGRVIATQLAAQGHIVYGSSRKAISDNPGFKMLQLDITDPASVSNAISTILKEQGSIDVLVNNAGMGISGAIELTTEEEIQRQMNTNFTGAVRMCAAVLPFMREAGHGRIINISSIAGVLAVPFQAFYSASKFAIEGYSEALYQEVKPLGIQVCVVEPGDFQTGFTAQRQVSQTSLSHAQYGESFAKAMRNVELSENNGCRPEKLGKAICKLVNSRRPAFRTKVGPWEQVFFARIKPMLPFSLVDWLIRKFY

SEQ ID NO: 1430 - protein, 253 aa, Artificial Sequence
  Synthetic
MGRLTGKVAVITGGNSGVGAATAKLFAAEGASVVITARRAAALEEIADEIRQAGGEVLALSTDISKPEDPERLMEAAMEKYGKIDILVNNAGILEAGLKPIDRFTDEDLDRIIDTNQKGTMRCIRAAAKRMQSGASIVNVASVAGEKGCGGAVYVSSKAAVIGVTKHTALRFQNDNIRCNAVCPGNILTPMTTGSAATAELDQDMIGAMATHSNLRTQSCTAEDVANILLFLASDESRAITGQVLVSDFGAML

SEQ ID NO: 1431 - protein, 247 aa, Artificial Sequence
  Synthetic
MLKGKNVIVTGATRGIGREIALTLAQNGANIAINYRNLNSEVENLLNEIKSFGVDAFAIKCDVSIADEVDKFIKEVKAHYNTIDVLVNNAGITKDGLILRMKEEDFDDVLDVNLKGTFNTTKSVSSIMVRQKYGKIINISSVVGIAGNAGQCNYAASKAGVIGFSKSVARELSSRNINVNVVAPGYINTDMTKNLPDKVKEEIIKSIPMKKIGDPKEVANLVLFLSSNLSDYITGQVINVDGGMVMA

SEQ ID NO: 1432 - protein, 235 aa, Artificial Sequence
  Synthetic
MNILVTGASRGIGKTIAKSLQSYGNVYVTARNEEKLKEFGNEMYFVCDLSKEEDLLKLGDFIQEKKIDILVNNAGEYTYCGIEDTEISKLNEMLSINLKAPIYLMHSAIPHMKKNKFGRVINIGSISGVMGEAYASMYSATKAGLIGLSKATGLELAEFGITVNTINPGWVDTELGKSSIEDSEFSEEEILESVPQRRFVKPEEIAGLVKYLISEEAKGITGQSINICAGLSVGI

SEQ ID NO: 1433 - protein, 267 aa, Artificial Sequence
  Synthetic
MNPYLNFSLEGKVALVTGASYGIGFAIASAFAEQGATICFNDINQELVDKGLAAYTEKGIKARGYVCDVTDEPAVQAMVAQIEKEVGSVDILVNNAGIIRRVPMHEMEAADFRRVIDIDLNAPFIVSKAVLPAMMKKGHGKIINICSMMSELGRETVSAYAAAKGGLKMLTRNICSEYGEYNIQCNGIGPGYIATPQTAPLRERQPDGSRHPFDSFIVAKTPAARWGTPEDLQGPAVFLASDASNFVNGLVLYVDGGILAYIGKQPK

SEQ ID NO: 1434 - protein, 253 aa, Artificial Sequence
  Synthetic
MNMYKYNDLNEKTVLVTGASGDIGLGICEKYLEQNCDVYALYKSNDVQLTALKASHPAGDKLHIVQCDLACPQSVSALCEQIEREAGKIDVLVNNAGIVKDSLFASMSYEDFTQVIETNMFSIFRLTKDALMLLRAAENPAIINVASIAALIPSVGQANYSASKGAILGFTRTLAAEMAPWGVRVNAVAPGMIESKMVKKVSRAVVRAVTSTIPLRRLGKCEEVANTIVFLSSSASSYIVGQTIVIDGGLVMR

SEQ ID NO: 1435 - protein, 247 aa, Artificial Sequence
  Synthetic
MKNKKTVLITGASRGIGRAIAILFAKNNYNVVINYNKSEEEAKSLLKELESENCSARIFKADISKIEEANALVNYTIGQFEKIDILVNNAGISRFNLFTDISYDEWHEVMNVNLNSVFYVTKKALQYMIPEHEGKIINISSMWGLVGSANEVHYSTSKAALIGMTKALAKELGPSNIQVNCIAPGVIETDMLNDVDEDTIEMLKYDTPLMRIGKPMDIARCALFLASEGGDFITGQVISSNGGFVIN

SEQ ID NO: 1436 - protein, 235 aa, Artificial Sequence
  Synthetic
MNTAIVTGASSGIGLSISKSILKCGYKVYGFGRDFSKIKNDDILNNSNFQPITCDLMNTSLLWEKIKEISKKESNLNLLVNNAGIGYFGPHEELNPKKIHEMVTVNLEVPLVLSQLLLRQLKKNQGYIINISSIEAKKSSVYGCAYGATKAGLTHFSESLFDETRKYGVKVITIHPDMTQTNFYRNSNFKEAEEYDTYITPDEVSCAVEMALNQRNGLVCTDITLRPQKHKIMRK

SEQ ID NO: 1437 - protein, 267 aa, Artificial Sequence
  Synthetic
MDYINNYSLEGKVALITGASYGIGFAIAKAMAGAGATIVFNDIKQELVDKGVAAYAEIGIKAHGYVCDVTNEDAVNAMVAQIENEVGVVDILVNNAGIIKRIPMIEMSAKDFRQVIDVDLNAPFIVSKAVIPSMIKKGHGKIINICSMMSEFGRETVSAYAAAKGGLKMLTRNICSEYGEHNIQCNGIGPGYIATPQTAPLREKQADGSRHPFDQFIVSKTPAGRWGEAEDLGGPAVFLASDASNFVNGQILYVDGGIQAYIGKQPS

SEQ ID NO: 1438 - protein, 253 aa, Artificial Sequence
  Synthetic
MAKNVVITGATSGIGEAIARAYLEKGENIVLTGRRIERLEALKAEFAEAFPNQNVWTFPLDVTDMTMVKTVCSDILGAVGSIDVLVNNAGLALGLAPYQDYDELDMLTMLDTNAKGLMAVTRCFLPSMVAANQGHIINMGSTAGIYAYAGAAVYSATKAAVKTFSDGLRIDTIATDIKVTTIQPGIVETDFSKVRFHGDEARAATVYQGIEALQAQDIADAVVYVTSQPRRVQITDMTIMANQQATGFTIHRD

SEQ ID NO: 1439 - protein, 247 aa, Artificial Sequence
  Synthetic
MEQVEKTALVTGAGKGIGKAIALAFAQVGYNVIINYNGSKEAAQSVLKEAESYGVKAITIQADVSKDEQVKAMIDQAMEQFGRIDVLVNNSGINKDGLMMRMSLEDFHKVIAVNLEGTFNCIKHVSRIMMKQRSGSIINMSSVVGLIGNAGQANYASSKAGVIGLTKSAARELALRQIRVNAIAPGFIDTDMTAKLAEKDKTKMMEQIPLKTFGKPEDVANVCVALASDAFSYVTGQVIHVDGGMVM

SEQ ID NO: 1440 - protein, 234 aa, Artificial Sequence
  Synthetic
MAVIITGGTGAIGSAMARAFAKTNDVAIIYKSSDEKARQLENELGCTAYKADVSSAKEVSAAVERIAADFGKIDVLINNAGISQIKMLSDVTELDWYNMIDVHLTGAFNMTKAVLPFMINRKQGSIINISSVWGVYGASCEVPYSTVKAGLIGFTKSLSKEVAPSGITVNCIAPGVIDSPMNNSHLSPDEMNELIAETPLGRLGTPDDVAQAAVYLAFAGFVTGQILGVDGGFY

SEQ ID NO: 1441 - protein, 267 aa, Artificial Sequence
  Synthetic
MHIAYVQGKDSVDFDYLEQRFYMENKVAIVTGASRGIGAAIAKKLASLGATVIVNYAGSREKAETVVKEIENAGGKATAMQCDISDFNKCSEFTNEVKDRFGSIDILVNNAGITRDGLCMAMKEEDFDAVINTNLKGTFNCIKFASRIMMKQRHGKIINMTSVSGVAGNAGQVNYSAAKAGVIGITKSMARELSSRNINVNAIAPGFIETDMTAKLSDKVKEQAVSQIPLNRFGKPEEVAELVAFLAGEKSNYITGQVFHIDGGMVM

SEQ ID NO: 1442 - protein, 253 aa, Artificial Sequence
  Synthetic
MGRLEGKVCIVTGASAGIGRATAELFCREGAKVVAVARREERLKELAEECKDAPGEMTWYAGDVGDPAAAVGMVKKAVETFGRLDVAVNCAGVMDDNTAIADMSDEMLEKTFRINTFGLMYGLREECKQYLAQGDGGVIVNICSVGATHQTAGAAYCASKGAVLAATKNTAFMYMEEGIRCNALSPGGVVTDIPLVMPPADEFGFGRTSKLLDFSGELAMPEDLADAILFLASDQSRYVNGEELKCDGGWTCF

SEQ ID NO: 1443 - protein, 247 aa, Artificial Sequence
  Synthetic
MNLKKKNVILTGANRGIGLAILKKLAKEGCNIWACCRTNTPETLSTFEQIARENCVWIKPIFFDLNEEESIKEGVLQILSEKKPIDVLVNNAGIPYGGLFYMTPMSKLKEVFQINYFSQIYIMQLVARYMMRQKKGCIVNMASVGGIETNAGYLAYGSSKAALIWATKSISKELGKYNIRVNAVAPGLTETQMGHYKSQEEIDKVLAVTSLGRMGTPEEIARSVCFLASEEASFITGQVLIVDGGRK

SEQ ID NO: 1444 - protein, 234 aa, Artificial Sequence
  Synthetic
MHSVIYRSEFMKNVLITGGATGIGRACAKLFAEKGYDVYITCNKTSAESIPGVTAIKCDLASVQNIKAIFNRFDRLDVLVNNAGISLIKMINDTEVSDYESLMAVNSRAVYFCAKEAALRMIKKHSGAIVNIASMWGEVGASCETLYSMSKAGVIGFTKALAKELAPSGITVNSVSPGIIDTRMNAAFDKAELAEETPLERLGTPEEVAETVLFLAENKYITGQDISVSGGIVV

SEQ ID NO: 1445 - protein, 267 aa, Artificial Sequence
  Synthetic
MEYLNDMFSLKGNVAFVTGGSYGIGFAIAKALARAGAVIAFNCRSEEHIQQAMKDYEREGIEAHGYLCDVTDEVHVQQLVAEIEKTLGTIDILVNNAGIIKRIPMCDMTTDEFRKVVDVDLVGPFIVSKAVIPGMIKKGHGKIINICSMMSELGRETVSAYAAAKGGLKMLTRNICSEFGGANIQCNGIGPGYIATPQTAPLREKQPDGSRHPFDQFIVSKTPAGRWGTTEDLEGPAVFLASHASDFVNGHILYVDGGILAYIGKQP

SEQ ID NO: 1446 - protein, 253 aa, Artificial Sequence
  Synthetic
MGKMEGKVVIITGGGKGIGFGLSTAFAKEGAKLVLTGRTVATLENAKKELEEKYGVEVLTVGADGANEEQVAHVVEEAVKKFGKIDVLINNAQTSKSGLMLEQHSKEDFDLAIYSGLYATFFYMKACFPYLKESRGAIINFASGAGLAGRAGQSSYAAAKEGIRGLSRVAATEWGPYGINVNVVCPLAMTPGLEAWRKEYPALYEQTIKGVPLGHFADAEKDIGRVCVFLASEDASYLTGETITLQGGSGLRP

SEQ ID NO: 1447 - protein, 247 aa, Artificial Sequence
  Synthetic
MLKGKNVIVTGATRGIGKEIALTLAQNGANIAMNYRNLNSEVEDLINEIKSFGVDVLAIKCDVSITDEVDNFVKEVKSHYNTIDILVNNAGITKDGLILRMKEEDFDDVLDVNLKGTFNTTKAVSSIMVRQKYGKIINISSVVGISGNAGQCNYAASKAGVIGFSKSVARELASRNINVNVVAPGYINTDMTKNLPDKVKEEIIKSIPMKKIGDPKEVANLVLFLSSNLSDYITGQVINVDGGMVMA

SEQ ID NO: 1448 - protein, 234 aa, Artificial Sequence
  Synthetic
MAVIITGGTGAIGSAMACAFAKKNDVAIIYKSSDEKARQLEKELGCKAYKTDVSSAQEASVAVERIAADFGKIDVLINNAGISQIKLLSDVTELDWYNMVDVHLTGAFNMTKAVLPFMISRKQGSIINISSVWGVYGASCEVPYSTVKAGLIGFTKSLSKEVAPSGITVNCIAPGVIDSPMNNAHLSPDEMNELIEETPLGRLGTPDDVASAAVYLASAGFVTGQVLGVDGGFY

SEQ ID NO: 1449 - protein, 267 aa, Artificial Sequence
  Synthetic
MGILNDFSLEGKVALVTGASYGIGFAIATAYAQAGATIVFNDIKQELVDKGVAAYKEEGIEAHGYVCDVTNEEAVTEMVKKIEEEVGVIDILVNNAGIIKRIPMLEMSADQFRQVIDVDLNAPFIVSKAVIPGMIKKGHGKIINICSMMSELGRETVSAYAAAKGGLKMLTRNIASEYGEYNIQCNGIGPGYIATPQTAPLREIQPDGSRHPFDQFIIAKTPAARWGDTADLQGPAVFLASDASNFVNGHVLYVDGGILAYIGKQPQ

SEQ ID NO: 1450 - protein, 253 aa, Artificial Sequence
  Synthetic
MDLKLKGKNVIVTGGSKGIGAGICKVFACEGANLIINYRSDPVAAQRFADDLIRNWGIRAVPVYADMTCPEDIDRLYREAEKQFPSLDVLVNNAACNVVFKPFQDYTADEWKEAQQGILDPVFYMSRLFVKHCIAQEKGGHIVNILSKSAILSSSICNLTYVANKGALTALTRGMAKEFVRYGIIVNGIIPGYVKTENQYIDGNERTERVRVLLPLKRFAQPEEIGNTAAILSSPLFAQMIGTIVDCTGGTLI

SEQ ID NO: 1451 - protein, 247 aa, Artificial Sequence
  Synthetic
MLLENKGAVVTGGSRGIGRAVAEALAAEGATVAVIYAGNIKAAEDTVRTIEEAGGKAFAVQCDVADEDAVTDMVKMVHEKLGTIDVFVNNAGITRDGLLMRMKREDWDAVLSTNLTGVYNCTKAVTKIMMKQRSGSIINMTSVVGETGNAGQANYAAAKAGVIGFTKSVAKELASRNIRVNAVAPGCIDTDMTAVLSDAVKEEMIKSIPLGRTAAPEEVAQAVVFLASQKAGYITGQTLNVDGGMVM

SEQ ID NO: 1452 - protein, 234 aa, Artificial Sequence
  Synthetic
MLTGKTALVTGAGGGIGREIAARLKAAGANVAICGRSVEKLEATARAIGGALTLPGDLLDDAYVQSCADRTVEAFGGLDILINNAGVALSKPFGETTIAEFDRVMATNARAPFVLIHSALPHLRRARGRIINIASVVAHKGYPLQSAYAASKHALLGLSKSLANELYQEGVRVHVISPGGVHTDMVRAARPDLSPDGLISAGEVADAVMFLLSLDKNAVIDEICLHRQGKAPFA

SEQ ID NO: 1453 - protein, 267 aa, Artificial Sequence
  Synthetic
MDYLNNMFSLKGNIALVTGGSYGIGFAIAKALARAGAVIAFNCRSQEHLDQAMKDYKREGIDAHGYICDVTDEIHVQQLVSEIEKTLGTIDILVNNAGIIKRIPMCDMTTEEFRQVVDIDLVGPFIVSKAVIPGMIKKGHGKIINICSMMSELGRETVSAYAAAKGGLKMLTRNICAEFGGANIQCNGIGPGYIATPQTAPLREKQPDGSRHPFDQFIVSKTPAGRWGTTEDLEGPAVFLASHASDFVNGHILYVDGGILAYIGKQQ

SEQ ID NO: 1454 - protein, 253 aa, Artificial Sequence
  Synthetic
MKRLENKTAIVTGGNSGIGKATAILFAKEGADLVLCARRKEALDEVAEECRKYGVQVVTVKADVSSHEDCSAVVKAAVDTFGKVDILVNNAGIVDKHRPITECTDEWWNEIIAIDQSSLFYMMKDTIPHMMEAGKGSIINVSSIGGVFGNGGISYSAAKSAALAMTKNVAIQLAPNGIRCNAVCPGPTPTPLNTPEKVAEFSTWFAERCAQHMDMSLPESSVEDQANAILFFAEDASAAVTGQYLIVDHGTTL

SEQ ID NO: 1455 - protein, 247 aa, Artificial Sequence
  Synthetic
MMQGKTAIVTGASRGIGRAVALTLAEEGANIVINYAGNENAAAETARLCEKFGVQTLLVRGNVALSEDCSRLVEETVKAFGTVDILVNNAGITRDNILMRMSDEDFDQVIATNLRGTYLMMKAVSRIMMKQRFGRIVNMASVVGLMGNSGQVNYAASKAGVVGMTKSFAREIAARGVTVNAVAPGFIATDMTADLPEAAVSSLIASIPKGSLGSPEDVANAVLYLASDEASFLNGVNLPIDGGVTCY

SEQ ID NO: 1456 - protein, 234 aa, Artificial Sequence
  Synthetic
MTKLKGQVAIITGASSGIGRATAYALASKGCHLVLTARREERLKEVKEKCEAMGSKVVYYVGDVCQERTAIQIVSLAIETFGRIDILVNNAGIGKLIPLVESTSDDYYEIMDTNVFSSFIFSKYAAIEMLKKRQGKIIFVSSVTGHVGHEDETIYTMTKFAQRRLSQAIDKELRSQEIKTCVVCPSATKTEFEVGYGRTKESVEAAHWETADDVAQGILYACKAENTVWEIRMR

SEQ ID NO: 1457 - protein, 267 aa, Artificial Sequence
  Synthetic
MDFNKLFSLEGKVALVTGAAYGIGFAIAEAYAKAGAKIAFNCRSQHHMDQALADYKAKSIDAKGYICDVTDEEQVKNMVADIEKELGVIDILVNNAGIIKRIPMTEMSVDDFKQVIDIDLTAPFIVSKAVIPGMIKKGHGKIINICSMMSELGRETVSAYAAAKGGLKMLTRNICSEYGEYNIQCNGLGPGYIATPQTAPLRERQADGSRHPFDSFICAKTPAGRWLEPEELEGPAVFLASEASNAVNGHILYVDGGILAYIGKQPK

SEQ ID NO: 1458 - protein, 253 aa, Artificial Sequence
  Synthetic
MEILTDKVALITGGSSGIGAETARVFAKHGAKVAIFARGREKLDQVAAELKALGAECLTITGDVTKSEDCNAAIDRVVTAFGRIDVLVNNAGAGDFHTTTEKCSDEFWDRMIALNQSSVLYCCRAVLPHMRSQGSGSIVNLSAIAGVYGNAGVSYSAAKAAVIAMTKNIALQYTGTDIRCNAVCPGPTAVDRMDGREDALIDQEFFAITDRHMDSSIPFASAEDQANVIAFLASDLSRCITGQAIITDNGRCL

SEQ ID NO: 1459 - protein, 247 aa, Artificial Sequence
  Synthetic
MLKDKVAVITGSSSGIGKEIAHTFAKNGAKVVVNYPFERSAAEAEAVVEEIKSNGGEAIAVMADVSNFEQAKELMKIAVDTFGALDILVNNAGITRDMLLLRMTEEEFDNVININLKGVFNCMKHATRIMMKKGGSIINMSSVVGLHGNIGQCNYSASKAGVVGMTKSAAKEFASKSLRVNAIAPGFIVSNMTDKLPETIKENTLKGIPLNRFGNVQEVANVALFLASDLSSYVTGEVIKVDGGMAM

SEQ ID NO: 1460 - protein, 234 aa, Artificial Sequence
  Synthetic
MKYILITGAARGIGYGLAQAYGEVGYYVVAGVRNSETENVRRLKATYGERFLAVEMDVSSTPSVIQAAEVVKRTVPYLDIIINNAATHAYDTQETFETCCVDNCLEVFNVNTLGPLRVTQAFFPLLERGTDKLLVNISSNAASIGDTTREKMLDYCMSKAALNMESRILQNSFHQKGIKVLALHPGWVRTDSGGPNNPLSPEESAAYIMRTADKYKDILYGPIYIDYTGKPMNY

SEQ ID NO: 1461 - protein, 267 aa, Artificial Sequence
  Synthetic
MDNKTNFSLEGKIALVTGASYGIGFAIAKAMAGAGATIVFNDIKQELVDKGIAAYKEEGITAHGYVCDVTNEDAVNAMVAQIEQEVGVIDVLVNNAGIIKRIPMIEMSAKDFRQVIDVDLNAPFIVSKAVIPSMIKKGHGKIINICSMMSEFGRETVSAYAAAKGGLKMLTRNIASEYGEYNIQCNGIGPGYIATPQTAPLRERQPDGSRHPFDQFIVSKTPAGRWGEASDLGGPAVFLASEASDFVNGQILYVDGGIQAYIGKQPS

SEQ ID NO: 1462 - protein, 253 aa, Artificial Sequence
  Synthetic
MSKNVFDDLKNKVVVVTGGTRGIGFATVKAFLQQGSKVVMLGSRKETVDKALHELSEYKDTVMGRYIDLNDLSACIDLLKEVLQEWGSVDVLINNAGVSDSKHFYSYEDADFDRVMNINLRSVFLMSKAAAEVMKKQKKGVILNTSSMVSIYGQPAGVAYPTSKFAVNGMTKSLARELGKDGIRVNAVAPGIIATDMVKALDPNMISAMAKGVPVQRLGEPEDIANAFLFLASDMASYISGAVLSVDGAYVLG

SEQ ID NO: 1463 - protein, 247 aa, Artificial Sequence
  Synthetic
VRTAIVTGSSRGIGRGIADLLDQNGYTVIYSGTKPERPADLPDEKSYFAADISDGTQRRALVAFAMEKYGRLDVLVNNAGIAPRVRRDILEMDEESFDEVLGVNLRGTTFMCQLAAKAMLEGKKTLSDYAPRIINIGSMSAYTASVNRGEYCISKAGVGMVTKLFAARLAAEGIPVFEVRPGIIDTDMTKGVHEKYRKLIDEGLLPVQRFGEPQDVARMVLACCSGLLDYSAGQTLDTDGGFSLRRL

SEQ ID NO: 1464 - protein, 234 aa, Artificial Sequence
  Synthetic
MKRTVLITGATSGYGLETAKLFQENGDTVIIASRNPEKVAATVKQYGFAKGYTIDVTKYDQWVQLKEDITKDFGTVDVLINNAGGGVKLVATVEQTRESIDEAIALNLSSAIYSSQLFAPGMMEQKDGVIVNISSICARHQWGTWTIYGAAKAGLLSFSKGLYTELRPYGIRVTCVLPGRASTGFQSNSGIEECEETMGPKDIANAVFYCVNQPKGVVVEEITVWGTSQDVQPL

SEQ ID NO: 1465 - protein, 267 aa, Artificial Sequence
  Synthetic
MIQLFLQIQYAKGGFMYNLKGKTAVITGGNSGVGAATAMLFAKSGANVVISARRQAALDEVASKIKAEGGNVLTVLTDISKDEDCKNLMKATVDKFGGIDILVNNAGVLDTGLAPIDKFDDVEIQKLISINQVGTMQCIRAALEYMQEGSSIVNVASVAGVNGGGGAAYVSTKSAIIGITKHTALLLADKYIRCNAICPGTIVTPMTMNMKPENLDMKMFGAMSKHADLKIKPCMAEDVANIIEFFASDNSKALTGQILVSDFGASL

SEQ ID NO: 1466 - protein, 253 aa, Artificial Sequence
  Synthetic
MKGKLVFITGATSGIGEGCARKFAAMGSNLILNGRNVEKLESLKKELTAQSVEVLTLPFDVRDRQAMRQAVDSLQDKWRHIDVLINNAGLVIGMDKEYEGSLEEWDVVIDTNIKALLAMTRMIVPGMVERGCGHIINIGSVAGDAAYAGGSVYCATKAAVKALSDGLRIDLVDTPLRVTNIKPGLVETNFSVVRFRGDKGKADAVYEGIRPLTGDDIAEVVYYAASAPAHIQIAEVLVMPTFQATGTVCYRKK

SEQ ID NO: 1467 - protein, 247 aa, Artificial Sequence
  Synthetic
MSESKVIVITGASSGIGEATAKLVAKDGAKVILGARRENKLKKIADGIEKLGGEAAYQATDVTDDNQVEALAKLAIDKFGRIDVWLNNAGIMPQSILSEKKINDWNNMIDINIKGTLYGIGAAIPYMDKQKAGHIINVSSVAGHTAHSGSAVYSATKYAVCAISESLRQEMVEAKNNVRVTVISPGAINTDLLSSVTDPEVKAGMEKVYESFGISVDRVALTIKEAIDMPADAAWNEVIIRPTNQMG

SEQ ID NO: 1468 - protein, 233 aa, Artificial Sequence
  Synthetic
MKTVIITGGSRGIGAAAVRAFCARGDRVAFLYEKEDEKAQAVAAETGAQAVRCDVADEAAIRAAFSQLPGADVLINNAGIADYDLINVITPARWRRLFAVNVDGAFYCIRAALPHMLQQQSGCIINVSSMWGQVGASCEAAYSATKGAILALTKALAQELGPSGIRVNAVAPGVIRTDMCASVDPAVMEDLRQQTPIGRLGTPEDIAQAMLYLADAPFLTGQTLPLNGGFVIT

SEQ ID NO: 1469 - protein, 267 aa, Artificial Sequence
  Synthetic
MENKTNFSLEGKVALVTGASYGIGFAIAKAMAGAGATIVFNDIKQELVDKGLAAYKEEGITAHGYVCDVTDEDAVNAFVKKVEEEVGVIDVLVNNAGIIKRIPMIEMAAKDFRQVIDVDLNAPFIVSKAVIPGMIKKGHGKIINICSMMSEFGRETVSAYAAAKGGLKMLTRNIASEYGEYNIQCNGIGPGYIATPQTAPLREKQPDGSRHPFDQFIVSKTPAGRWGEASDLGGPAVFLASDASDFVNGQILYVDGGIQAYIGKQPS

SEQ ID NO: 1470 - protein, 243 aa, Artificial Sequence
  Synthetic
MKVAIVTGASKGIGRACAIRLAKDGYAVVVNYSHSESHAQATLDEIKNNGGEGMIYKADVSKLDDAKAMIRDVYKEYGSIDVLVNNAGIVRDEFLLMMSSQTLDDCFQLNVKGYFYCAQQAALKMFRKKAGVIINMSSVSGKFSLPGQSVYSATKGAVNSMTQTLAKELAPYGIRVNAVAPGFIETEMLDHIPVEKKEEYLKNIPLHKLGRTEDVANLVSFLASDASAYITGQTITLDGGLSL

SEQ ID NO: 1471 - protein, 247 aa, Artificial Sequence
  Synthetic
MENTTKVALITGATRGIGKQIALELAENGYNISLNYRTLSDEVNNLKSEIESKGVKCLLVNGDVSDFESCENMAKETVQSLGQIDVLVNNAGITKDGLLMRMKKEDFTKVIDINLVGTFNMTRNVIPFMIKKRSGRIINVSSVVGITGNAGQTNYSASKAGVIGFTKSLAKEVASRNILVNAIAPGFIATDMTSVLSDAVKENINSQIPLNRMGSPKEIAKVVKFLASEDSSYITGQVINIDGGMVM

SEQ ID NO: 1472 - protein, 233 aa, Artificial Sequence
  Synthetic
MNILVTGASKGIGNAIAKELEKSGNLYVTGRNEKALRECVCKDYCVCDLANDIEILAEFIEKNKIDILINNAGEYIYGALETMSTTDIQRIYQTNLISPAYLISKAIPSMKSNKWGRIINIGSISGVMGEAYASLYSSSKAGLIGLTKALALELAEYNITVNTINPGWVETELGMNSIDESEFSKEEIIECIPQKRFVKPQEVAKLCKYLISEDAKGITGQSINLCAGLSVGI

SEQ ID NO: 1473 - protein, 267 aa, Artificial Sequence
  Synthetic
MSEFTNFSLEGKVALVTGASYGIGFAIASAYAECGATICFNDIKQELVDKGIAAYAEKGIKAHGYVCDVTNEEAVNAMVAQIEKKVGTIDILVNNAGIIKRIPMTEMTADQFRQVIDVDLNAPFIVSKAVIPAMIKKGHGKIINICSMMSELGRETVSAYAAAKGGLKMLTKNICSEYGQYNIQCNGIGPGYIATPQTAPLREIQPDGSRHPFDQFIVAKTPAARWGNAEDLGGPAVFLASEASDFVNGLILYVDGGILAYIGKQPG

SEQ ID NO: 1474 - protein, 253 aa, Artificial Sequence
  Synthetic
MKGKTVFITGATSGIGEGCARKFAAMGSNLILNGRNTEKLESLKKELTATGIEVLSLPFDVRDRQAMHQAVASLQGQWRNIDVLINNAGLVIGMDKEYEGSLDEWDIVIDTNIKALLAMTRMIVPGMVERGCGHIINIGSIAGDAAYAGGSVYCATKAAVKALSDGLRIDLVDTPLRVTNIKPGLVETNFSVVRFRGNQHKADAVYEGLQPLTGDDIADVVYYTASAPAHIQIAEVLVMPTSQATGTICHRQK

SEQ ID NO: 1475 - protein, 247 aa, Artificial Sequence
  Synthetic
MSLKGKTALVTGASRGIGKEIAKTLAAEGAYVVVNYNGSKEAADNVVAEICSQGGAAESYGCNVSDFSAVEVMIKDIIEKHGTLDILVNNAGITRDNLIMKMKEEDFDSVIAINLKGTFNTAKHVARQMLKQKSGCIINISSISGVMGNAGQANYAASKAGVIGLTKSLARELASREIRVNAIAPGFIETDMTQQLSESVIEAGKAQIPFGRFGNAKEVAGAVKFLASDDASYITGQVLHVDGGMGM

SEQ ID NO: 1476 - protein, 233 aa, Artificial Sequence
  Synthetic
MKTVVITGGSRGIGAAAVRLFAGRGARVWFLYEKNHEAARAVARETGAQALCCDVADEAAVQRAFDAVGSADILVNNAGVCHYGLISQITPAEWRRLFAVNVDGIYNCVRAVLPQMLQKQSGAIVNVSSMWGQVGASCEAAYSATKGAVLALTKALAQELGPSGIRVNAVAPGVIRTDMCASVAPEVMEELRQQTPTGTLGTPEDAAQAIAYLADAPFVTGQVLAVNGGFVIT

SEQ ID NO: 1477 - protein, 267 aa, Artificial Sequence
  Synthetic
MKHPQIILVTGASSGFGRVIATQLAAQGHIVYGSSRKAVSDNSGFKMLQLDITDPASVANAISTILEEQGSIDVLVNNAGMGISGAIELTTEEEIQHQMNTNFTGAVRMCAVVLPFMRKAGHGRIINISSIAGVLAVPFQAFYSASKFAIEGYSEALYQEVKPLGIQVCVVEPGDFQTGFTAQRQVCQTSLSHAQYGESFAKAMRNVEQSENNGCRPEKLGKAICKLVNSRRPAFRTKVGPWEQVFFARIKPMLPFSLVDWLIRKFY

SEQ ID NO: 1478 - protein, 253 aa, Artificial Sequence
  Synthetic
MGRLDGKVCIVTGASAGIGRATAELFCREGAKVVAVARREERLKELAEECKDAPGEMTWYAGDVGEPATAVGMVKKAVETFGKLDVAVNDAGIMDDNTAIADLSDEMLHETFRINTFGLMYGMREECRQYLAQGDGGVIVNICSVGATHQTSGAAYCASKGAVLAATKNTAFMYMEEGIRCNAVSPGGVVTDIPLVMPPSDEFGFGRTSKLLDFSGELAMPEDLADAILFLASDQSRYVNGEELKCDGGWTCF

SEQ ID NO: 1479 - protein, 247 aa, Artificial Sequence
  Synthetic
MEENPEKNIVNKVVVVTGSSRGIGANIVKTLAKKGYRVILNYNKSENYAQNVQKELINVDIFKADVSKKEEAVSLINFAIEKYGKIDVLINNAGISQSKLFTDLTDEDWNNIINSNLNSAFFCSREAAKNMIHNKSGLIINISSIWGITGASCEVAYSTSKAALNGFTKALAKELGPSNIRVNAIAPGIINTDMNNYLSNEELESIKEEIPLERIGETIDISKCVEWLIKDNYTTGQIISINGGWVC

SEQ ID NO: 1480 - protein, 233 aa, Artificial Sequence
  Synthetic
LNILVTGASKGIGRAIAEELKSCGNLFVSARNAEALKSIGAKDYCVCDLSKNPGVLGDFIEKNEIDVLVNNAGEYIYGAIDKMTPEEIERIHKTNLIAPAYLISRAVGRMKTEKFGRIVNVGSISGVMGEANASLYSSSKAGLIGLTKALALELAEFNITVNTINPGWVDTELGMNSIEESEFSKEEIVECIPQRRFVEPQEVAKLVKYLISEDAKGITGQGINLCAGLSVGI

SEQ ID NO: 1481 - protein, 267 aa, Artificial Sequence
  Synthetic
MDLTAFDLKGKVALVTGGAHGIGFSIAEGMAKCGATVCFNCSNEGSLEKGLAAYKAVGIDAHGYVADVTDEAAVNAMIAQIKAEVGPVDILVNNAGLMKRVPMIEMSHTDFLRVIDVHVGGAFNCSKAVLPDMIAKREGKIINICSMMSELGRETVSAYAAAKGALKMLTRNIASESASTTSSATAWALATLPPLRPLPCARSSPMAAAIPSIPSSAPRPPQAAGAPPRTWSAPACSWPPMLPTLSTARSCTLMAASWLTSASSPSK

SEQ ID NO: 1482 - protein, 253 aa, Artificial Sequence
  Synthetic
MKGKIILITGATSGIGEGCARKFAAMGSKLILNGRNIEKLKSLKQELEKTGTEVITLPFDVRNREEMRNAIDSLQGEWKNIDVLINNAGLVLGVDKEHEGSLDEWDIVIDTNIKGLLAMTRMIVPGMVERGCGHIINIGSIAGDAAYAGGSVYCATKAAVKALSDGLRIDLVDTPLRVTNIKPGMVETNFSVIRFRGDKNKADAVYDGLKPLTGDDIAEVVYYAASAPAHVQIAEVLVMPTYQATGTVCHRQK

SEQ ID NO: 1483 - protein, 247 aa, Artificial Sequence
  Synthetic
MYLFDLTGKTALVTGGTRGIGLAIALGLKEAGADVWIHGSRRESTEKAAAQYGFSYLYGDLKDSKNLETMVKPLMDSTDTLDVLVNNAGFETHCPVESAMEEEMDSVYNVNAKSPFFLLQKLLPMLRKSEGASVINVTSIHQKVPVRENGYYCMAKASLSMFTKVAALELAKENIRVNNLAPGAILTDMNRELVENMEFEQWIPLERVGRAEELVGPAVFLASAASSYVTGTTLYVDGGYSENLLRY

SEQ ID NO: 1484 - protein, 233 aa, Artificial Sequence
  Synthetic
MLTNKKVIITGGCKGIGKCIAEKFLEENAYVSVTYWKSKELAELTKAEFAHYGEKFNIYQMDVSDMKMVYEVMSKIQNELGGVDILINNAGIIKDSILYSMSEEDWDQVIKTNLYGCFYTIKSVLYNMIKQRSGSIINISSVSGIKGIPGQTNYCASKAGIIGLTKALAEELSTKNIRVNAIAPGYVKTDMIAELKSINGKIIFPEQIANVAKFLATEESNCINGEVIVAGNS

SEQ ID NO: 1485 - protein, 267 aa, Artificial Sequence
  Synthetic
MGILNDFSLEGKVALVTGASYGIGFAIATAYAQAGATIVFNDIKQELVDKGIAAYKEEGIEAHGYVCDVTKEEAVTEMVKKIEEEVGVIDILVNNAGIIKRIPMLEMSADQFRQVIDVDLNAPFIVSKAVIPGMIKKGHGKIINICSMMSELGRETVSAYAAAKGGLKMLTRNIASEYGEYNIQCNGIGPGYIATPQTAPLREIQPDGSRHPFDQFIIAKTPAARWGDTADLQGPAVFLASDASNFVNGHVLYVDGGILAYIGKQPQ

SEQ ID NO: 1486 - protein, 253 aa, Artificial Sequence
  Synthetic
MRLSGKSIVVTGASAGMGHAIVERFVKEGALVTAVARRRERLEELAESLKEEPGKIVICTGDIGDENTSSRMIDLAVQEFGRLDVLLNVAGIMDDNTAVGDVSDEMLDRLFRINTLGPLYAMRKAVQVFLSQNDESGNIINVTSVGAAHQTAGVAYCASKAALTAATKNTAYMYLEKGIRCNAIAPGGVVTEIPLVMPTPDEFGFGRSSALLTHAPELGMPENIAEAALFLASDESRFVNGTILTCDGGWTAF

SEQ ID NO: 1487 - protein, 247 aa, Artificial Sequence
  Synthetic
MKLNGKVALVTGASRGIGAAIASKLASLGCDVAINYAGNIQKAEETLNSVKAYGVNAQIYQANVANYEEVEAMTKQIIKDFGHLDIIINNAGITSDNLMMRMDQDSFDSVIDVNLKGTWNVCKSITRPILKQRSGVIINLSSVVGINGNVGQVNYAASKAGVIGLTKSLAKEFASRNIRVNAVAPGYVKSDMTAKLSEEITEKVLENIPLGQLGEVEDIANSVAFLVSDEARYITGQVLVVDGGMAI

SEQ ID NO: 1488 - protein, 233 aa, Artificial Sequence
  Synthetic
LILKLNNMMEKKIVLITGASSGIGEGCARKFAMNGYRLILNGRNVEKLNAVKKELLEKYGADVYLLPFDVRDRQAARAALESLPEEWKAVDILVNNAGLVIGVDKEHEGNLDEWDIVIDTNVKALLAMTRLVVPGMVERGRGHVINMGSIAGDYAYPGGSVYCACKAAVKALSDGLRIDLVDTPVRVTNIKPGLVETNFSVVRFRGNREAADNVYKGEFYNSIYPLVSDSRTL

SEQ ID NO: 1489 - protein, 267 aa, Artificial Sequence
  Synthetic
MNRLQDKVAVVTGSTSGIGVGIARLFAAEGAKVVICGRREEKGQAVVDSIAQDGGEAWYHFMDITVTESIEKLFADTAEKYGKIDILVNNAANVGLKDGRVDELSLEMWDAVFQSDVRGTFYATKCVLPYMQKNENGGSIINIGSMASCGGDLGSTAYACAKAGVDMLTQSTALQYGKQNIRCNCVRPGLIVTPENEASVPQALKDVFLSNIMVNRYGCPEDIGHMCVYLASDESAYVSGQIVNVDGGLNSHVSTVAQFREMNSRTW

SEQ ID NO: 1490 - protein, 253 aa, Artificial Sequence
  Synthetic
MKRKTILITGATSGIGEGCARKFAAMGSRLILNGRNTEKLESLKRELEKTGTEVVTLPFDVRNREEMRNAIDSLQGEWKNVDVLINNAGLVLGVDKEHEGSLDEWDIVIDTNIKGLLAMTRMIVPGMVERGCGHIINIGSIAGDAAYAGGSVYCATKAAVKALSDGLRIDLVDTPLRVTNIKPGMVETNFSVIRYRGDKNKADAVYDGLKPLTGDDIAEVVYYAASAPAHVQIAEVLVMPTYQATGTVCHRKK

SEQ ID NO: 1491 - protein, 247 aa, Artificial Sequence
  Synthetic
MLLDGKVALVTGASRGIGRAIALRLASEGAKVAINYAGSTAKAEAVKTEIEQNGGEAILVQADVSDSASVDAMVAKVIEAFGQIDILVNNAGITRDGLMMRMKDEDFDAVINTNLKGVFYCTKVVSKLMMKKRSGRIINMASVVGLMGNAGQTNYAAAKAGVIGFSKSAAKELAARGITVNMVAPGFIATDMTAAMTDKAKEMTLTGIPLKRMGEPEDVANAVLFLASDNASYITGQTINVDGGMVM

SEQ ID NO: 1492 - protein, 233 aa, Artificial Sequence
  Synthetic
LVRNIVITGATGDIAKEIVKSLSKENDHLILVSRSRKALIERYGQLENVTLLTNDELLTNEQSFVVDILINNAGFGIFKEFTELTDGEITEQFVINTLMPIQLTRLLEPKVQLINIASIAGKLPTGKSSIYAASKAALITFSDALRMENPQLIVTTVNTGPVKTKFHKDNGDYLEKVGKNAISASKVADKVVNNLGKRKREINLPWTLSTAAKLRAIFPSLFDFISAKFFNFK

SEQ ID NO: 1493 - protein, 267 aa, Artificial Sequence
  Synthetic
MGILNDFSLEGKVALVTGASYGIGFAIATAYAQAGATIVFNDIKQELVDKGIASYKEEGIEAHGYVCDVTDEAAVCDMVKKIEEEVGVIDILVNNAGIIKRIPMLEMSADQFRQVIDVDLNAPFIVSKAVIPGMIKKGHGKIINICSMMSELGRETVSAYAAAKGGLKMLTRNIASEYGEFNIQCNGIGPGYIATPQTAPLRELQADGSRHPFDQFIIAKTPAARWGDTEDLKGPAVFLASDASNFVNGHVLYVDGGILAYIGKQPQ

SEQ ID NO: 1494 - protein, 253 aa, Artificial Sequence
  Synthetic
MKGKLIFITGATSGIGEACARKFAEMGSNLILNGRNTEKLEALKEELTGRGVEVLTLPFDVRNREEMRRAVDSLEGKWQQIDVLVNNAGLVLGMDKEHEGSLDEWDIVIDTNIKALLAMTRMIVPGMVERQRGHIINIGSIAGDAAYAGGSVYCATKAAVKALSDGLRIDLVDTPLRVTNVKPGMVETNFSVVRFRGDKDKADAVYNGIRPLTGEDIAEVVYYAASAPEHVQIAEVLVMPTYQATGTVCHRQL

SEQ ID NO: 1495 - protein, 247 aa, Artificial Sequence
  Synthetic
MLLEGKVALVTGASGGIGKAIALAYAKEGAAVAVHYHGNEEKAKAVQKEIEESGGKAEIFCCNVAEFAACDAMIKAVVKTFGKLDILVNNAGITRDGLIMGMTEKDFDDVLDTNLKGSFHCIRFASRQMMRKKYGRIINITSVSGVAGNPGQANYSASKAGLIGLTKSVAKELASRNITANAIAPGFVNTEMTDVLSAEVKEAAKAQIPLSRFAEPEDIAHAAVFLASDMASYITGQVLLVDGGMVM

SEQ ID NO: 1496 - protein, 232 aa, Artificial Sequence
  Synthetic
MKQKVLITGASRGIGFAMAKRFAEAGYAVYALWHNQKEQLDTIGALDITPVHGDVADAASVAAVRDAVGAVDILVNNAAISRFGLITDLSEAEWDEMMAVNLKSVFLLSRAFLPDMIRRQSGRIINVSSIFGAVGGSCEVAYSAAKAGVIGFTKALAKEVGPSGIQVNCIAPGVIDTAMNARLSAEDLAALRDETPLGRLGTPEDVANLALFLAADKFITGEVLHIGGGYLR

SEQ ID NO: 1497 - protein, 267 aa, Artificial Sequence
  Synthetic
MNPYLNFSLEGKVALVTGASYGIGFAIASAFAEQGATICFNDINQELVDKGLAAYTEKGIKARGYVCDVTDEPAVQAMVAQIEKEVGSVDILVNNAGIIRRVPMHEMEAADFRRVIDIDLNAPFIVSKAVLPAMMKKGHGKIINICSMMSELGRETVSAYAAAKGGLKMLTRNICSEYGEYNIQCNGIGPGYIATPQTAPLREKQADGSRHPFDSFICAKTPAGRWLDPEELTGPAVFLASEASNAVNGHILYVDGGILAYIGKQPK

SEQ ID NO: 1498 - protein, 253 aa, Artificial Sequence
  Synthetic
MKRKTALITGATSGIGMACARRFAVGGYNLIITGRSADKLQSLKAELEAGGVKVLALAFDVCNREATRDAVASIPDAFKPIDVLINNAGLARGLEPEYEGDFQDWDEMIDTNIKGLLNMTRFVVPEMVSLNHGHVINIGSVAGDAAYAGGGVYCATKAAVKALTDGLRIDVAHTSVRVTNLKPGLVETNFSNVRFHGDNERADNVYKGIKPLVGDDIADVAFYAASAPEHVQIAEVLVLATHQANGTVVHRES

SEQ ID NO: 1499 - protein, 247 aa, Artificial Sequence
  Synthetic
MLLEGKNALITGAARGIGAAMVEVFAREGANVWAFARTPDARFEARLAMTAGKYGRWVKPVYCELTDAAALKEAFRQVLTDKQPLNVLVNNAGVMGEDRMFQMTGEEDMRRIMDVNFFALVEVSRLATRLMARGKCGAVVNIASVAGIDGDSRLDYSASKAAVIAATKKMARELISLGIRVNALAPGFTDTDLVSGLSEKVTQEQLGRILMGRKARPEEIADVAAFLASDRASYVTGQVWRVDGGIL

SEQ ID NO: 1500 - protein, 232 aa, Artificial Sequence
  Synthetic
MTKRVLITGVSSGIGLAQARLFLEKGYQVYGVDQGADPQLAGDFHFLQRDLTLDLTPIFDWCPEVEVLCNTAGVLDDYKPLLEQTAQEIQEIFEINYVTPVELTRYYLTQMLEKKQGIIINMCSIASSLAGGGGHAYTSSKHALAGFTKQLALDYAEAGIQVFGIAPGAVKTGMTAADFEPGGLADWVASETPIKRWIKPEEVAEVSLFLASGKASAMQGQILTIDGGWSLK

SEQ ID NO: 1501 - protein, 267 aa, Artificial Sequence
  Synthetic
MDVMKSFSLEGKVALVTGAAYGIGFAIAEAYAKAGAKIVFNCRGQEHMDIAMKAYEEKGIDAKGYLCDVTDEAQVADMIQDIEKTVGTIDILVNNAGIIKRIPMTDMSAEEFRQVIDVDLNAPFIVSKAVIPGMLKKGHGKIINICSMMSELGRETVSAYAAAKGGLKMLTKNIASEYGEFNIQCNGIGPGYIATPQTAPLREIQPDGSRHPFDQFIISKTPAARWGNPEDLMGPAVFLASEASDFVNGQILYVDGGILAYIGKQPK

SEQ ID NO: 1502 - protein, 253 aa, Artificial Sequence
  Synthetic
MENKKVVLITGGTSGIGFGTIEYLLEQGNYEIISVSRGDKNIALAKEKLGEKANQVIFLQGDVSKEEDCKKIYTEVESKYGKLDGLVNSAGIIKLGGIEEQTLEEWNNAININLTAIFLLSKTLLPLLKKGRNTSVVNISSMSSERAGGSIAYCASKAGVDMLTKYMAQELGKYNIRVNSVNPAAVYTNIYVASGDYTQEDYDKWSEEKAPLYPLGRIGDAKKDLAPTIEFLLSDKSLWTTGAIYLVDGGKSI

SEQ ID NO: 1503 - protein, 247 aa, Artificial Sequence
  Synthetic
MSTKKTALITGSSRGIGREIARLFAKNNYNVVINYNNSEEEAKKLLDELTNDGCSVKIFKADISNVNEANALVNFTIGNFEKIDVLVNNAGISRFNLFTDISYDEWHEVMNVNLNSVFYVTQKALQYMLSEHSGKIINISSIWGMVGAANEVHYSTSKAALIGMSKALAKELGPSNIQVNVIAPGVIETDMLKEVDDDTIEMLKYETPLMRIGKPIDIARCALFLASEGGDFITGQVISSNGGFVIN

SEQ ID NO: 1504 - protein, 232 aa, Artificial Sequence
  Synthetic
MNKRVLITGVSSGIGLAQARLFLEKGYQVYGVDQGADPQLSGAFHFLQRDLTLDLTPIFDWCPEVEVLCNTAGVLDDYKPLLEQSAQEIQEIFEINYVTPVELTRYYLTQMLEKKQGIIINMCSIASSLAGGGGHAYTSSKHALAGFTKQLALDYAEAGIQVFGIAPGAVKTGMTAADFEPGGLADWVASETPIKRWIEPEEVAEVSLFLASGKATAMQGQILTIDGGWSLK

SEQ ID NO: 1505 - protein, 267 aa, Artificial Sequence
  Synthetic
MDFIKNYSLEGKVALITGASYGIGFAIAQAMAGAGATIVFNDIKQELVDKGVEAYAAEGIKAHGYVCDVTDEDAVNAMVAKIEEEVGVVDILVNNAGIIKRIPMIEMAAKDFRQVIDVDLNAPFIVSKAVIPSMIKKGAGKIINICSMMSEFGRETVSAYAAAKGGLKMLTRNIASEYGEYNIQCNGIGPGYIATPQTAPLREKQADGSRHPFDQFIVSKTPAGRWGEATDLGGPAVFLASEASDFVNGQILYVDGGIQAYIGKQPS

SEQ ID NO: 1506 - protein, 253 aa, Artificial Sequence
  Synthetic
MGLVEGKVIIVTGASSGIGEKTAEVLAAEGAKVVLAARRKEKLEDVANRIIAAGGEAYTVSGDVSVREDCDRIAEETVKKYGRIDVLVNNAGIGDKQMAITRCSDEWWRQIIAVNQDSVFYMSRAALVYMEKQGEGSIVNISSIGGVFANAGIAYSAAKAAVVAMTKNVAIQLAPNGIRCNAVCPGPTPTPLNTPEKVAEFSIWFAERCAQHMDMSLPESSVEDQANAILFFAEDASAAVTGQYLIVDHGTTL

SEQ ID NO: 1507 - protein, 247 aa, Artificial Sequence
  Synthetic
MEETTKVALITGATRGIGKQIALELAENGYNVSLNYRTLSDEVNSLKAEIESKGVKCLLVSGDVSDFESCEKMAKETVESLGQIDVLVNNAGITKDGLLMKMKKEDFTKVIDVNLVGTFNMTRNVIPFMIKKKSGRIINVSSVVGVTGNAGQTNYSASKAGIIGFTKSLAKEVASRNILVNAIAPGFIATDMTSVLSDEVKEGINAQIPLKRMGTAREIAKVVKFLASEDSSYITGQVINIDGGMVM

SEQ ID NO: 1508 - protein, 232 aa, Artificial Sequence
  Synthetic
MTKRVLITGVSSGIGLAQARLFLEKGYQVYGVDQGADPQLPGAFHFLQRDLTLDLTPIFDWCPEVDVLCNTAGILDDYKPLLEQSAQEIQEIFEINYVTPVELTRHYLTQMLEKKKGIILNMCSIASSLAGGGGHAYTSSKHALAGFTKQLALDYAEAGIQVFGIAPGAVKTAMTAADFEPGGLADWVASETPIKRWIEPEEVAEVSLFLASGKASAMQGQILTIDGGWSLK

SEQ ID NO: 1509 - protein, 267 aa, Artificial Sequence
  Synthetic
MHATSYKLRLHGKVMSTVKGAAMEKKVALVTGASRGIGRQISLTLAKEGMFVIVNYCGSEARAKGVLEEIRENGGDGCIYQCDVADYQQTEAMARDLIKTYGHVDVLVNNAGITRDNLILRMSEEEFDAVVETNLKGCFHTIRHLSRYFLKQRSGKIINIASVSGVLGNAGQANYAASKAGIIGLTKTVARELASRGITVNAVAPGFVHTEMTEVLSEQVKEAAVAQIPLGRFGEPEDIANVVAFLASEKADYITGQVICVDGGMAM

SEQ ID NO: 1510 - protein, 253 aa, Artificial Sequence
  Synthetic
MLLKDKVAIITGANSGIGHECALRFLAEGAMVAGVDINTGSMGSLAEAAEKYGTQFEAYQCDVRSEESVKGVVEAVAERFGGRIDIMLNVAGITVDMPVTRTEKSVFDRVIDVNAGGTFNFCKQVAVFMKKQRCGSIVNTSSVTAQFGTQMGTPYSASKAAILGITRSLAMELAPWNIRVNAVAPGVVNTEMVSNLNDMERESCARSIPLGRLGEPGDIANAMLFLASDMASYVTGTTLNVDGGYRPVFVPLH

SEQ ID NO: 1511 - protein, 247 aa, Artificial Sequence
  Synthetic
MENIEKTALVTGASRGIGRAIALALAAKGFAVALNYAGSHDAAEAVKKEIEEAGGKAFTIQGDVSKSEDVDRIFKAVKDEFGGLDVLVNNAGINRDALLIRMKESNWDDVIATDLKSDFLTTKAAAAMMMRKRKGSIINISSVVGIMGNIGQANYAAAKAGVIGLTKACAKEMAARNIRVNAVAPGFIETAMTDGIPEKIREGMISSIPMGRMGQPEDIAKAVCFLASDDSSYITGQVLVVDGGLVM

SEQ ID NO: 1512 - protein, 232 aa, Artificial Sequence
  Synthetic
MTKTVLVTGVSSGIGRAQARLFLENGWHVYGVDQSKKPNLTGDFHFLQQDLTLALQSVFDWCPQVDVLCNTAGVLDDYKPLLEQTAQEIQEIFEINYVTPVELTRYYLTQMLKKQSGIIINMCSIASSLAGGGGHAYTSSKHALAGFTKQLALDYAEQGVQVFGIAPGAVKTSMTAADFEPGGLAQWVADETPIKRWIEPEEVAELTLFLASGKAQPMQGEIVKIDGGWSLK

SEQ ID NO: 1513 - protein, 267 aa, Artificial Sequence
  Synthetic
MMEAAMRLGLEGKTVVITGGAGGIGKEAARGFLKEGAAVAVFARTEEKVDDFCREMRGLGYDNFYGEVLDVADKEGVRWFTEKVCRKFGTVDVWINNAGIAIDKPFLEYTEDEWDTIMNTDLKAVWDCIRLVAPIMMKQERGVIINISSFAAKIPSAGGAIYGAAKSGVSSLTRTLAAELAPYHIRVLGVVPGMIDTEISKANIKENGEQLVQNVSLGRLGAAEDLAGPIVFLASEQAEYMTGFDLEVTGGKFAVQNTRWAWNLKEE

SEQ ID NO: 1514 - protein, 253 aa, Artificial Sequence
  Synthetic
MKGKTILITGATSGIGEGCARKFAAMGSKLILNGRNTEKLENLKLELEKAGTEVVTLPFDVRDREEMRNAINSLQGEWKDIDVLINNAGLVLGVDKEHEGSLDEWDIVIDTNIKGLLAMTRMIVPGMVERGCGHIINIGSIAGDAAYAGGSVYCATKAAVKALSDGLRIDLVDTPLRVTNIKPGMVETNFSVIRFRGDKNKADAVYDGLKPLTGDDIADVVYYAASAPAHVQIAEVLVMPTYQATGTVCHRQK

SEQ ID NO: 1515 - protein, 247 aa, Artificial Sequence
  Synthetic
MLLEGKNALITGAARGIGAAMVEVFAREGANVWAFARTPDARFEARLAMTAGKYGRWIKPVYCELTDTAALKEAFRQVMADKQPLNVLVNNAGVMGEDRMFQMTSAEDMRRIMDVNFFATMEVSRLATRLMARGKCGAVVNVASVAGIEGDSRLDYSASKAAVIAATKKMARELISVGIRVNALAPGFTDTDLVSGLSEKVTQEQLSRILMGRKARPEEIADVAAFLASDRASYVTGQVWRVDGGML

SEQ ID NO: 1516 - protein, 232 aa, Artificial Sequence
  Synthetic
MTKRVLITGVSSGIGLAQARLFLENGYQVYGVDQGADPQLAGDFHFLQRDLTLDLTPIFDWCPEVEILCNTAGVLDDYKPLLEQSAQEIQEIFEINYVTPVELTRHYLTQMLENKKGIIINMCSIASSLAGGGGHAYTSSKHALAGFTKQLALDYAEAGIQVFGIAPGAVKTGMTVADFEPGGLADWVASETPIKRWIEPEEVADVSLFLASGKASAMQGQILTIDGGWSLK

SEQ ID NO: 1517 - protein, 267 aa, Artificial Sequence; identical to SEQ ID NO: 1369
  Synthetic

SEQ ID NO: 1518 - protein, 253 aa, Artificial Sequence
  Synthetic
MILDMFSLKGKTAIVTGANTGLGQGMCVALAEAGADIAGVARRDCDETKKLVEEAGARFLQVKADLSSMEPIDEIIKSAVEEFGHIDILVNNAGIIKRNDAIDYTEEDWDSVVFLNQKFTFFLCQAAAKQFIAQKSGGKIINIASMLSYQGGIRVPSYTASKSAVLGLTRAMANEWAKYDINVNGIAPGYMATNNTQALRNDDDRSDEILSRIPAGRWGTPSDMAGAVVYLASSASDYVNGFTLAVDGGWLAR

SEQ ID NO: 1519 - protein, 247 aa, Artificial Sequence
  Synthetic
MGELLKDKVCIVTGASHGIGKGIVNDFLDEGAIVYGCARTLDSMKEIMVANPRFTALYFDVTDVVEAKNAIMQIKKEQGRIDVLVNNAGIVYNRKIGMISREETEAMFRTNVFAVIDLTQLVSRIMARNGKGAIVNISSVTAVLGSAGQSAYSATKGAIISFTRSAAKELAPLGIRVNAVAPGIVKTERFEELYEVSGDKIDSRIQKISLNRLGTPKDIAYACTFLASDKSSYISGQILGVDGCASI

SEQ ID NO: 1520 - protein, 232 aa, Artificial Sequence
  Synthetic
MTKVLITGVSSGIGLAQARLFLENGCAVYGVDKSQAPEIQNENFHFLQLDLTTDLAALYDFVQDVDILCNTAGILDAYKPLLEVSDDELERVFQTNFFATVKITRYYLAKMVERQSGIIINMCSIASFIAGGGGAAYTASKHALAGFTRQLALDYAKDKIQVFGIAPGAVKTAMTASDFEPGGLADWVAQETPIGRWSKPEEIADLTEFLASGKATSMQGEIIKIDGGWSLK

SEQ ID NO: 1521 - protein, 267 aa, Artificial Sequence
  Synthetic
MNPYLNFSLEGKVALVTGASYGIGFAIASAFAEQGAKICFNDINQELVDKGLAAYKEKGIAVHGYVCDVTDEPAVQAMVAQIEKEVGPIDILVNNAGIIRRIPMHEMAASEFRKVIDIDLNAPFIVSKAVLPGMMERRHGKIINICSMMSELGRETVSAYAAAKGGLKMLTRNICSEYGEYNIQCNGIGPGYIATPQTAPLREKQPDGSRHPFDSFICAKTPAGRWLDPQELTGPAVFLASEASNAVNGHILYVDGGILAYIGKQPK

SEQ ID NO: 1522 - protein, 253 aa, Artificial Sequence
  Synthetic
MKGKLIFITGATSGIGEGCARKFAHEGCNLILNGRNIEKLESLKRELSAQGTEVLTLPFDVRDRQAMRQALDSLEGKWRNIDVLVNNAGLVIGMDKEHEGSLDEWDIVIDTNIKGLLAMTRMIVPGMVERGCGHIINIGSIAGDAAYGGGSVYCATKAAVKALSDGLRIDLVDTPLRVTNIKPGMVETNFSVIRFRGDQNKADAVYEGIRPLTGDDIADVVYYAASAPAHVQIAEVLVMPTYQATGTICHRQK

SEQ ID NO: 1523 - protein, 247 aa, Artificial Sequence
  Synthetic
MLENKIAIVTGGSTGIGYEICNLFAKEKATVVMCGITEASAKEGAKKLILENKNARIVPRKLDITKAEEVSNFMESIYKEFGKINILVNNAGVCFAKSLLDTTEEDFINLMNVNTNGTFRCTKEAVKYMKETGGSIINTSSMVGTYGSPNQVAYTASKFAINGITKSCAKELGKYNIRVNAVAPGVVKTKMTEDNVNDEMGEYLKRMTPLGRTAIPSDLAGTYLYLASDLSKFTTGAIIAVDGGLVF

SEQ ID NO: 1524 - protein, 232 aa, Artificial Sequence
  Synthetic
MTKGVLITGVSSGIGLAQARLFLEKGYQVYGVDQGADPQLAGDFHFLQRDLTLDLTPIFDWCPEVDVLCNTAGVLDDYKPLLEQSAQEIQEIFEINYVTPVELTRHYLTQMLEKKRGIIINMCSIASSLAGGGGHAYTSSKHALAGFTKQLALNYAEAGIQVFGIAPGAVKTGMTAADFEPGGLADWVASETPIKRWIEPEEVAEVSLFLASGKATAMQGQILTIDGGWSLK

SEQ ID NO: 1525 - protein, 267 aa, Artificial Sequence
  Synthetic
MSILKNFSLEGKIAFVTGASYGIGFAIASAYADAGAKIVFNDINQELVNKGLAAYKEAGIEAHGYVCDVTDEEAVQATVKKIEEEVGVIDILVNNAGIIKRIPMLEMKAEDFRKVIDVDLNAPFIVSKAVIPGMIKKGHGKIINICSMMSELGRETVSAYAAAKGGLKMLTRNICSEYGEYNIQCNGIGPGYIATPQTAPLREKQPDGSRHPFDQFIVAKTPAARWGSTEDLQGPAVFLASDASNFVNGHVLYVDGGILAYIGKQPQ

SEQ ID NO: 1526 - protein, 253 aa, Artificial Sequence
  Synthetic
VGRRKLELKRFQGKNVIVTGATSGIGKATALLLAKEGANVIAVGRNEKRGRDVCKEISNLGGKALFFQCDLSKEEKVKELYEKIEEQFESIDLLFNNAGIWITEPLENISEEMVMTVFSSDFNSVLFMTKYFIPMLKKKHGVIINNASMGGLEGYTSGSKQYLYHSSKAAAIKFSKLTAKNYATEIRVNCICPGLIDTEIYENRDFSRFYDVIPMKRMGEAEEVAKLVAFLASEDASYITGAVIPIDGGASLT

SEQ ID NO: 1527 - protein, 247 aa, Artificial Sequence
  Synthetic
MRLEGKKALVTGASRGIGRAIALALAAEGADVAVNYAGSEAAAKEVAAEIEAMGRKAIVIQADISSHEASTAMIDEVVKEFGRIDILVNNAGITRDGLLMRMKEADWDAVLTTNLKGVFNCTKAAVKYMMKQKYGRIVSISSVVGLMGNAGQANYAAAKAGVIGFTKAVAKEVAARGINVNAVAPGFIKTDMTSVLSEKVVENLVAGIPLNRLGETEDIAKAVLFLVSDDANYITGQTLHVDGGMVM

SEQ ID NO: 1528 - protein, 232 aa, Artificial Sequence
  Synthetic
MTKRVLITGVSSGIGLAQARLFLEKGYQVYGVDQGADPQLPGAFHFLQRDLTLDLTLIFDWCPEVDVLCNTAGVLDDYKPLLEQSAQEIQEIFEINYVTPVELTRHYLMQMLEKKQGIILNMCSIASSLAGGGGHAYTSSKHALAGFTKQLALDYAEAGIQVFGIAPGAVKTAMTAADFEPGGLADWVASETPIKRWIEPEEVAEVSLFLASGKASAMQGQILTIDGGWSLK

SEQ ID NO: 1529 - protein, 267 aa, Artificial Sequence
  Synthetic
MNPYLNFSLEGKVALVTGASYGIGFAIASAFAEQGATICFNDINQELVDKGLAAYTEKGIKARGYVCDVTDEPAVQAMVAQIEKEVGSVDILVNNAGIIRRVPMHEMEAADFRRVIDIDLNAPFIVSKAVLPAMMKKGHGKIINICSMMSELGRETVSAYAAAKGGLKMLTRNICSEYGEYNIQCNGIGPGYIATPQTAPLREKQADGSRHPFDSFICAKTPAGRWLDPEELTGPAVFLASEASNAVNGHVLYVDGGILAYIGKQPK

SEQ ID NO: 1530 - protein, 253 aa, Artificial Sequence
  Synthetic
MKGKVIFITGATSGIGEGCARKFAAMGSDLILNGRNVEKLESLKQELTAQGVDVLILPFDVRDRQAMRQAVDSLQGKWKNVDVLINNAGLVIGLDKEYEGSLEEWDVVIDTNIKALLAMTRMIVPGMVERGCGHIINIGSVAGDAAYAGGSVYCATKAAVKALSDGLRIDLVDTPLRVTNVKPGLVETNFSVVRFRGDKGKADAVYEGIRPLTGDDIAEVVYYAASAPAHIQIAEVLVMPTNQATGTICYRKK

SEQ ID NO: 1531 - protein, 247 aa, Artificial Sequence
  Synthetic
MRFQDKTAIVTGGSRGIGREIALTLAKDGANIAILQIGDDENAAKTKQEITELGVKCEVYTCDVSSYDGVKETVDKVIEAFGAVDILINNAGIVRDATLRSMKEQDFDAVLSVNLKGAFNMIKHLYTHFMKRRSGRIVNISSVVALGGNAGQANYVSAKAGLIGLTKTVAKELGGRGITCNAVAPGYIDTDMTKTLSDKVKENFTALIPMRKPGSVQDVANAVAFLASDEAAYITGEVLRVDGGMAM

SEQ ID NO: 1532 - protein, 232 aa, Artificial Sequence
  Synthetic
MNILITGASQGLGLELAKSALKRGYRVFAVARHVSPELGELQGENCSIHTADITSAADVDRVYGEIGQETENLDYLFNNAGVWLDKSRVSLTDPSFSFDDVSRQFEVNAVGPLRITRTFLPMLLAGNGKCIINLSSEAGSIGNACRRCEYGYCMSKAALNMETKLLQNAYPELRLYAIHPGWMKTPQGYAGATKDCTPQQEPSDTAEKLLTLAETKKYPYLYGDFEGNPMPW

SEQ ID NO: 1533 - protein, 267 aa, Artificial Sequence
  Synthetic
MMGFLTGKTAIITGGGRAVLSDGSCGSIGYGIATAYAKEGANLVLTGRNVKKLEDAKEELERLYGIKVLPVQADVSAGADNEAIVQNVVKQTIDTFGRIDVLINNAQASASGVPLEEHTTDQFNLALYSGLYAVFYYMKACYPYLKETKGSVVNFASGAGLFGNYGQCAYAAAKEGIRGLSRVAATEWGKDGINVNIVCPLAWTAQLENFEKAYPEAFKANVKMPPAGHYGDVEKEIGRVCVQLASPDFKYMNGETLTLEGGMGQRP

SEQ ID NO: 1534 - protein, 253 aa, Artificial Sequence
  Synthetic
MNLSLKGKTAVVTGAAKGIGRSIAEKMAESGAAVGIIDFDKATGFAAQEEFTAKGYKCVFAAADVSNYESLVQAKQQLVDAFGKIDILVINAGVSRKHTIAEIEPAEWERVISINLSGSFYTVKAFYDCFADKKPEDEGRIIFVTSGSGITGTGGGAHYAASKSGQHGLMRTVSKEFGKNGVNVNAIAPRVIVTDLFDTLYPTEESKEQLMAKIPIGRFGYPDDIANLACFLAAPESSYIHGQIILMDGGRTL

SEQ ID NO: 1535 - protein, 247 aa, Artificial Sequence
  Synthetic
MRLKDKVAIVTGGGRGLGKGIAMKLAEEGARVVVADMAPADEAVAEMRAKGGTAVSFQVNVSKQEEVKAMVQFAIDTYGTLDIMVNNAGINRDGMLHKMSKENWDTVIAVDLTGTFYGTQEAVNYMRSKNYGRIINISSGSWLGNIGQANYAAAKAGVIGLTKTAARENARKGITCNAICPGFIETDMTLKLKDVNDGAAWDSMMQRIPMGYAGKPEDVGNMVAFLASDEASYVTSEVINVGGGMIV

SEQ ID NO: 1536 - protein, 232 aa, Artificial Sequence
  Synthetic
MTKRVLITGVSSGIGLAQARLFLEKGYQVYGVDQGADPQLPGAFHFLQRDLTLDLTPIFDWCPQVDVLCNTAGVLDDYKPLLEQSAQEIQEIFEINYVTPVELTRHYLTQMLEKKQGIIINMCSIASSLAGGGGHAYTSSKHALAGFTKQLALDYAEAGVQVFGIAPGAVKTGMTAADFEPGGLADWVASETPIKRWIEPEEVAEVSLFLASGKASAMQGQILTIDGGWSLK

SEQ ID NO: 1537 - protein, 267 aa, Artificial Sequence
  Synthetic
MKHTQIILVTGASSGFGKVIATQLAAQGHTVYGSSRKAVSDNPDFKMLQLDITDPASVSNAISTILAEEGRIDVLVNNAGMGISGAIELTTEDEIQRQMNTNFIGAVRMCAAVLPSMREAGQGRIINISSIAGVLAVPYQAFYSASKFAIEGYSEALYQEVKPFGIQVCVVEPGDFRTGFTAQRQMNEATLSHSQYGEHFTRTMQNVEQSENNGCHPEKLGRAVCKLVNKRQPAFRTKVGPWEQVFFARIKPMLPFRLTDWLIRKFY

SEQ ID NO: 1538 - protein, 252 aa, Artificial Sequence
  Synthetic
MQRTALITGATAGFGAAICRTLIENGYRVIGTGRRVARLEQLQQELGENFHFLAFDISDRQATEDAFHSLPANWQSIDLLVNNAGLGLGLESADKASLDDWMQMIDTNIKGLVTITRLVLPQMVERNSGHIINLGSIAGTYPYPGGNVYGGTKAFIKQFSLNLRADLAGTQIRVSNVEPGLCGGTEFSNIRFKGDDARAKKLYENVEYVSPQDIANIVLWLNQQPEHVNINRIEVMPTAQTFAPLNVARIQK

SEQ ID NO: 1539 - protein, 244 aa, Artificial Sequence
  Synthetic
MDKCALITGATRGIGKQIAITLAKQGYNIALNYRKENEELENTKKEIEKIGVQVLAVKGDVANFENCENFVKQVIERFGQIDVLVNNAGITKDMLLMRMKKEDFEQVIDTNLVGTFNVTKNVVPYMMKARSGRIINISSVVGISGNAGQTNYSASKAGIIGFTKSLAKEIASRNILVNAVAPGFIETNMTDVLKDDVKQEIAKNIPLKRMGTTQDVANVVKFLASDDSSYITGQVINVDGGMLM

SEQ ID NO: 1540 - protein, 232 aa, Artificial Sequence
  Synthetic
MTKRVLITGVSSGIGLSQARLFLEKGYQVFGVDQGANPQLPGNFHFLQRDLTLDLMPIFDWCPEVEVLCNTAGVLDDYKPLLVQSAQEIQEIFEINYVTPVELTRYYLTQMLENKKGIIINMCSIASSLAGGGGHAYTSSKHALAGFTKQLALDYAESGIQVFGIAPGAVKTGMTAADFEPGGLADWVASETPIKRWIEPKEVAEVSLFLASGKASAMQGQILTIDGGWSLK

SEQ ID NO: 1541 - protein, 267 aa, Artificial Sequence
  Synthetic
MEKGTNMFSLEGKVALVTGASYGIGFAIATAYAQAGATIVFNDIRQELVDKGLKAYHELGIDAYGFVCDVTDEKAVHELVEKIEREIGTVDILVNNAGIIKRIPMTDMSVDDFRKVVDVDLTAPFIVAKAVIPGMIRKGHGKIINICSMMSELGRETVSAYAAAKGGLKMLTRNICSEYGEHNIQCNGIGPGYIATPQTAPLRERQSDGSRHPFDQFIVSKTPAARWGETQDLKGPAVFLASEASDFVNGHVLYVDGGILAYIGKQP

SEQ ID NO: 1542 - protein, 252 aa, Artificial Sequence
  Synthetic
MGKLDNKVAIITGGNAGVGKEIAKLFASEGAKVVISARRQQVLEEAAKEIEAAGGTVLCVPTDISKVDDVKNLVSKTVETFGQLDILINNAGVLDKGLNAIDQIDYDDLNRVIDINQKGTMYCMSEALKVMKSGVSIVNISSVAGQYGAGGAVYVSTKAAIIGVTKHAAMRFAKEKIRCNVICPGSITTDMAAGLTPDTMDMKMMGAMSAHSDLTLQPCSPLDVAKVALFLASDDAAPLTGQVVVSDYGVDL

SEQ ID NO: 1543 - protein, 247 aa, Artificial Sequence
  Synthetic
MNRLENKKVIITGGCHGIGKAIVEKCLQEGGVVATTYNSSANQAQELKKELKEYADRLFVYQMDVRNPEQVDLIMEHMMEQLSGIDVLVNNAGITKDSLFFMMKNEDWDDVIKTNLYGTFYTTKSAVINMVRKKKGSIVNISSVSGVIGVAGQSNYCASKFGIIGLTKSLAKELAYKNIRINAVAPGYIETDMVAKLGDQVNDLVKKKGTLGRLGTPEEIADTVVFLACDEASYITGQVLVADGGII

SEQ ID NO: 1544 - protein, 232 aa, Artificial Sequence
  Synthetic
MTKSVLITGVSSGIGLAQARLFLEKGYQVYGVDQGADPQLAGAFHFLQRDLTLDLMPIFDWCPEVEVLCNTAGVLDDYKPLLEQSAQETQEIFEINYVTPVELTRHYLTQMLKKKQGIIINMCSIASSLAGGGGHAYTSSKHALAGFTKQLALDYAEAGIQVFGIAPGAVKTGMTAADFEPGGLADWVASETPIKRWIEPEEVAEVSLFLASGKASAMQGQILTIDGGWSLK

SEQ ID NO: 1545 - protein, 267 aa, Artificial Sequence
  Synthetic
MAILDDFSLKGKIALVTGASYGIGFAIASAYAQAGATIVFNDIKQELVDKGLAAYEELGIKAHGYVCDVTNEEQVNELVKKIEAEVGVIDILVNNAGIIKRIPMCDMTAAEFRQVIDVDLNAPFIVSKAVIPSMIKKGHGKIINICSMMSELGRETVSAYAAAKGGLKMLTKNIASEYGEYNIQCNGIGPGYIATPQTAPLREVQPDGSRHPFDQFIIAKTPAARWGNAEDLQGPAVFLASDASNFVNGHVVYVDGGILAYIGKQPQ

SEQ ID NO: 1546 - protein, 252 aa, Artificial Sequence
  Synthetic
MPTACITGASSGIGKEFAAQLAARGYNLILVARNTKALEELAAELACKCRIISCDLSKEAQCMQLAEELKPLDIHILINNAGFGDLDRFAQSDLSKSLDMINVNIKALHILTRKLLPELMKKDRGYILNVASSAGLLPGGPYMSTYYATKAYVTSLTNAIYQELQEVHSNVHISMLCPGPVNTNFNETANVTFALPGISAKRCVSYCLKEMSKGTLTIVPSPLMRAAVWGSRFTPKKILLSILSKQQKKKGY

SEQ ID NO: 1547 - protein, 247 aa, Artificial Sequence
  Synthetic
MNVNVSGIVVVITGASRGIGRALAIEFAKEQACVVVNYNRSYFETKKLMDEINAYNNNCLFVQADVTKQEDVKKLYNETIKKYGRVDVLINNAGICEDSLIHLMSKEKWQKVIDTNLTGVFLCSRTFSKAMIHQKKGKIINISSLKGQEGNPGQVNYSASKAGLIGFSKALAKELGDFNIAVNTICPGFIVTDLNKHNVKKRLIAEKRSTLKIDHGMKNVINFILFLAWTEIEGISGRVFNLDSRIL

SEQ ID NO: 1548 - protein, 232 aa, Artificial Sequence
  Synthetic
MTKRVLITGVSSGIGLAQARLFLEKGYQVYGVDQGADPQLPGEFHFLQRDLTLDLTPIFDWCPEVDVLCNTAGVLDDYKPLLEQSAQEIQEIFEINYVTPVELTRHYLTQMLEKKQGIIINMCSIASSLAGGGGHAYTSSKHALAGFTKQLALDYAESGIQVFGIAPGAVKTGMTAADFEPGGLADWVASETPIKRWIEPEEVAEVSLFLASGKASAMQGQILTIDGGWSLK

SEQ ID NO: 1549 - protein, 267 aa, Artificial Sequence
  Synthetic
MDILKNFSLEGKVALVTGAAYGIGFAIAEAYGLAGAKIAFNCRSKEHLDKALKDYEEKGIEAKGYICDVTDEEQVAQMVADIEKELGVIDILVNNAGIIKRIPMTDMSVEEFRQVVDIDLNAPFIVSKAVIPSMINKGQGKIINVCSMMSELGRETVSAYAAAKGGLKMLTKNIASEYGEYNIQCNGIGPGYIATPQTAPLREIQPDGSRHPFDQFIIGKTPAARWGTPEDLMGPALFLASKASDFVNGHILYVDGGILAYIGKQPK

SEQ ID NO: 1550 - protein, 252 aa, Artificial Sequence
  Synthetic
MDRLKGKVAIITGGNSGVGEATAKMFAKEGATVVITARREAALEKVAEEIKAAGGEVFAVSTDISKKGDPERLMDLVIKKYGKVDILVNNAGILEEGLKPIDRFSDEDLDRIVETNEKGTMRCMRAASQKMQAGASIVNVASIAGVKGCGGAAYVASKAAIVGVTKHTALRFQATGIRCNAICPGNIITPMTSGTNPAALDPDMIGAMSTHSNLRTPSCTAEDVANVILFFASDESKAITGQAIVTDFGAML

SEQ ID NO: 1551 - protein, 247 aa, Artificial Sequence
  Synthetic
MKLEGKKALVTGASRGIGRAIALALAAEGADVVVNYAGSEAAAKEVAAEIEAMGRKAFVVQADISSTEAATAMVDQVVKEFGRIDILVNNAGITRDGLLMRMKEEDWDAVLTTNLKGVFNCTKAAVKYMMKQKAGRIVSISSVVGLMGNAGQANYAAAKAGVIGFTKSVAKEVAARGITVNAVAPGFIKTDMTAVLSDKVVEGMLNNIPLHRLGETTDIAKAVVFLVSDDANYITGQTLHVDGGMVM

SEQ ID NO: 1552 - protein, 232 aa, Artificial Sequence
  Synthetic
MTKRVLITGVSSGIGLAQARLFLEKGYQVYGVDQGADPQLAGDFHFLQRDLTLDLTPIFDWCPEVEVLCNTAGVLDDYKPLLEQSAQEIQEIFEINYVTPVELTRHYLTQMLEKKQGIIINMCSIASSLAGGGGHAYTSSKHALAGFTKQLALDYAEAGIQVFGIAPGAVKTGMTAADFEPGGLADWVASETPIKRWINPEEVAEVSLFLASGKASAMQGQILTIDGGWSLK

SEQ ID NO: 1553 - protein, 267 aa, Artificial Sequence
  Synthetic
MERLKNKVAIVTGSTSGIGIGIARLYAAEGAKVVICGRREEKGQAVVDSIVKDGGEAFYHFMDITVSESIEKLFADTVEKYGKIDILVNNAANVGLKDGRVDELTLEMWDNIFQSDVRGTFYAIKSVLPYMQKNENGGSIINIGSMASCGGDLGSTAYACAKAGIDTLTQYTALQYGKQGIRCNCVRPGLIVTPENEAYVPQALKDIFLSNIMVDRYGCPEDIGHMCVYLGSDESAYVSGQIVNVDGGLNSHVPTVAQFKELHSRTW

SEQ ID NO: 1554 - protein, 252 aa, Artificial Sequence
  Synthetic
MDRLKGKVAIITGGNSGVGEATAKMFAKEGATVVITARREAALEKVAEEIKAAGGEVYAVSTDISKKGDPERLMDLVIEKYGKIDILVNNAGILEEGLKPIDRFSDEDLDRIVETNEKGTMRCMRAAAQKMQAGASIVNVASIAGVKGCGGAAYVASKAAIVGVTKHTALRFQATGIRCNAICPGNIITPMTSGTNPAALDPDMIGAMSTHSNLRTPSCTAEDVANVILFFASDESKAITGQAIVTDFGAML

SEQ ID NO: 1555 - protein, 247 aa, Artificial Sequence
  Synthetic
VSNVVALVTGASRGIGASIAMEFAKAGVHVVLNYNRHALMAEKVAEKIKEKYDVDVLCVKADISIEEEVEAMVNQVVDCFGKIDILVNNAGICKDSLLLDKSVSNFRKILDVNLIGTYLCSKYVGKVMLDRGSGKIINISSTNAIDTYYPESCDYDASKAGVISLTHNLAREFAPNISVNCICPGWVKTDMSEGLSIEQIREEEDKILLHRFAEAEEIAKVVVFLASSKASYINDSIIRVDGGRFYG

SEQ ID NO: 1556 - protein, 232 aa, Artificial Sequence
  Synthetic
MTKRVLITGVSSGIGLAQARLFLEKGYQVYGVDQGADPQLPGAFHFMQRDLTLDLTPIFDWCPEVDVLCNTAGVLDDYKPLLEQSAQEIQEIFEINYVTPVELTRHYLTQMLEKKRGVIINMCSIASSLAGGGGHAYTSSKHALAGFTKQLALDYAEAGIQVFGIAPGAVKTGMTAADFEPGGLADWVASETPIKRWIEPEEVAEVSLFLAKGKASAMQGQILTIDGGWSLK

SEQ ID NO: 1557 - protein, 267 aa, Artificial Sequence
  Synthetic
MSDFINFSLEGKVALVTGASYGIGFAIASAYAEAGATICFNDIKQELVDKGLAAYAEKGIKAHGYVCDVTNEEAVNAMVAQIEKEVGTIDILVNNAGIIKRIPMTEMTADQFRQVIDVDLNAPFIVSKAVIPAMIKKGHGKIINICSMMSELGRETVSAYAAAKGGLKMLTKNICSEYGQYNIQCNGLGPGYIETPQTAPLREKQPDGSRHPFDQFICAKTPANRWLKPEELTGPAVFLASEASNAVNGHILYVDGGILAYIGKQPE

SEQ ID NO: 1558 - protein, 252 aa, Artificial Sequence
  Synthetic
MGLLTGKTAIVTGAARGIGKAVAMKFASEGANIAFTDLVLNDEMAAGLEATRKEIEALGVTCRAYAGNAADFEETEKTVKQIHADFGSIDILVNNAGITKDGLMLRMSEAQWDAVLNVNLKSAFNFIHACAPVMLRQRSGSIINMASVVGVHGNAGQCNYAASKAGMIALAKSIAQELGPKGVRANAVAPGFIETAMTAQLPEDIRKDWMKKIPLRRGGQTEDIANVCLFLASELSSYVSGQVIQIDGGMNM

SEQ ID NO: 1559 - protein, 247 aa, Artificial Sequence
  Synthetic
MKRLQNKTAVLTGANKGIGLAILNKLAEEGANVIACSSRKSEERQTLFATIAERNGIEVTPIYFDMSDEESVKVGIKEIKDLKQPIDILVNNAGVGKMAILAFTKMSDVHRIFQINYFSPLMIIQSLVGVMKKSEAPSIINMSSVAGLDGGIGVSIYGSTKASIALTTKVLAQEFSQMKIRVNAVAPGMIKTDMADNMGDKAKESMVAASASKRLGTAEEVANLVAFLASEESSYINGQIIRVDGGL

SEQ ID NO: 1560 - protein, 232 aa, Artificial Sequence
  Synthetic
MTKRVLITGVSSGIGLAQARLFLEKGYQVYGVDQGADPQLPGAFHFLQRDLTLDLTPIFDWCPEVDVLCNTAGVLDDYKSLLEQSAQEIQEIFEINYVTPVELTRHYLTQMLEKKQGIIINMCSIASSLAGGGGHAYTSSKHALAGFTKQLALDYAEAGIQVFGIAPGAVKTGMTAADFEPGGLADWVASETPIKRWIEPVEVAEVSLFLASGKASAMQGQILTIDGGWSLK

SEQ ID NO: 1561 - protein, 266 aa, Artificial Sequence
  Synthetic
MTENTHIPASPFLPHTGDGKVAVVTGASSGIGRATVHQLVASGWTVYALARRTDRLYTLYAETGAHPVTCDVTDEHSVRFVAEQILEEQGTIDALVNIAGGAIGVDKVADGKTVDYLKMYQMNVLGILHMVRAFAEALRMNGHGTILNLTSTAAEHGYEGGAGYNAAKFGARGLTEALRLEEAENNIRVIEICPGMVHTEEFSLNRLGSKEAADRVYAGVEKPLTAEDVAQTVTFALNVPHHVNLDRITIRPVAQPSQFKVIRKES

SEQ ID NO: 1562 - protein, 252 aa, Artificial Sequence
  Synthetic
MDKIVFITGASSGIGAGCARKFASQGASLILNARNVNKLSALKEELEKQYGTEIYLLPFDVRDRKAATSALESLPKEWQSIDILVNNAGLVIGTDKEQEGSLDEWDIVIDTNIKALLAMTRLIVPGMVERKRGHIINIGSIAGDAAYPGGSVYCATKAAVKALSDGLRIDLVDTPLRVTNIKPGLVETNFSVVRFRGDKEKADNVYKGIRPLTGDDIAETVYFAASVPEYMQIAEMLVMPTNQATGTIVSRK

SEQ ID NO: 1563 - protein, 247 aa, Artificial Sequence
  Synthetic
MNNIQDKVVVVTGASSGIGEAIVRKLASEGASVVLAARRKDRLENIAGEINASGGKASYYVVDVTVEKQIRDMVDDVVARLGRLDVMVGNAGLMAQAPLSSLKVDEWDRMIDINIKGVLYGVAAAWPVFEKQQSGHFINISSVAGIKVAAPTGTVYSATKYAVRAISEGIRVESAGKFRSTVVYPGYVESELMYGSSDEKTRQAVISGYEKYAIPAGSVANAVAYAISQPDDTAINEIVIRPTSQEF

SEQ ID NO: 1564 - protein, 232 aa, Artificial Sequence
  Synthetic
MTKRVLITGVSSGIGLSQARLFLEKGYQVYGVDQGADPQLPGNFHFLQRDLTLDLIPIFDWCPEVDVLCNTAGVLDDYKPLLEQSAQEIQEIFEINYVTPVELTRHYLTQMLEKKQGIIINMCSIASSLAGGGGHAYTSSKHALAGFTKQLALDYAEAGIQVFGLAPGAVKTGMTAADFEPGGLADWVASETPIKRWIEPEEVAEVSLFLARGKASAMQGQILTIDGGWSLK

SEQ ID NO: 1565 - protein, 266 aa, Artificial Sequence
  Synthetic
MSFLNNFSLEGKIALVTGASYGIGFAIASAYAEAGATIVFNDIKQELVDKGLAAYAEKGIKAHGYVCDVTNEEQVNELVKKVEEEVGVIDILVNNAGIIKRIPMCDMSAAEFRQVIDVDLNAPFIVSKAVIPSMIKKGHGKIINICSMMSELGRETVSAYAAAKGGLKMLTKNIASEYGEFNIQCNGIGPGYIATPQTAPLREIQPDGSRHPFDQFIIAKTPAARWGQAEDLQGPAVFLASDASDFVNGHVVYVDGGILAYIGKQP

SEQ ID NO: 1566 - protein, 252 aa, Artificial Sequence
  Synthetic
MGLLSGKTALVTGAARGIGKAVAMKFASEGANIAFTDLVLNDDMAAGLEATRKEIEALGVTCRAYAGNAADFEETEKTVKQIHADFGSIDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTAQLPEEIRKDWMKKIPLRRGGQTEDIANVCLFLASDMSSYVSGQVIQIDGGMNM

SEQ ID NO: 1567 - protein, 247 aa, Artificial Sequence
  Synthetic
MLLQGKTAVVTGGSRGIGRAVAVALAAEGAGVAVVFAGNTAAAAETVRIIENAGGTAVAVQCDVADEAAVADMIKKVQEKFGSVDILVNNAGITRDGLLMRMKSDDWNAVINTNLTGVYNCTKGVTKMMMKQRNGSIINMTSVVGETGNAGQANYAAAKAGVIGFTKSVAKELASRGIRVNAVAPGCIDTDMTAVLSDAVKEEMIKTIPLGRTAAPEEVAQAVVFLASDRAGYITGQTLNVDGGMVM

SEQ ID NO: 1568 - protein, 232 aa, Artificial Sequence
  Synthetic
MTKRVLITGVSSGIGLAQARLFLEKGYQVYGVDQGADPQLAGDFHFLQRDLTLDLTPIFDWCPEVEVLCNTAGVLDDYKPLLEQSAQEIQEIFEINYVTPVELTRYYLTQMLEKKQGIIINMCSIASSLAGGGGHAYTSSKHALAGFTKQLALDYAEAGIQVFGIAPGAVKTGMTAVDFEPGGLADWVASETPIKRWIEPEEVAELSFFLASGKASAMQGQILTIDGGWSLK

SEQ ID NO: 1569 - protein, 266 aa, Artificial Sequence
  Synthetic
MDMSSFSLEGKIALITGASYGIGMAIAKGMAAAGATIVFNDIKQELVDKGLAAYEEAGIKAHGYVCDVTNEDAVNELVAKIEAEVGVIDILVNNAGIIKRIPMCEMTAAQFRQVIDVDLNAPFIVAKAVIPSMIKKGHGKIINICSMMSELGRETVSAYAAAKGGLKMLTRNICSEYGEYNIQCNGIGPGYIATPQTAPLREIQPDGSRHPFDQFIIAKTPAARWGEAEDLAGPAVFLASDASNFVNGHVLYVDGGILAYIGKQPQ

SEQ ID NO: 1570 - protein, 252 aa, Artificial Sequence
  Synthetic
MNRKIFVTGATSGIGLECARAFAQDGDNVLIAGRRADRLAAIKEDFEQQYGIRVDTLVLDVSKREDVDAKVKPAIEAFGGIDVLVNNAGLAQGLDPFQDSTVEDAVTMINTNVLGLLYVTKAVLPFMIDKNEGHIVNMGSTAGIYAYPGGAVYCATKAAVKMLADGIRMDTIATDIKVTTIQPGIVETPFSEVRFHGDAERAASVYAGIEAVQPEDVADVVLYVTNQPKRLQISDVTIMANQQAAGFMVHKK

SEQ ID NO: 1571 - protein, 247 aa, Artificial Sequence
  Synthetic
MQIDLTGKNALVTGASRGLGRAIALSLARAGADVVITYEKSVDKAQAVVDEISALGRHSEAVQADSASAEAIQDAVTHAARTLGGLDILVNNAGIARGGPLESMTLADIDALINVNIRGVVIATQEALVHMSDGGRIINIGSCLANRVAMPGISVYSMTKSALNSFTRGLARDLGPRGITVNLVHPGPTNSDMNPEDGEQAEAQRQMIAVGHYGQPEDIAAAVTFLASPAAGQISGTGLDVDGGLNA

SEQ ID NO: 1572 - protein, 232 aa, Artificial Sequence
  Synthetic
MTKTVLVTGVSSGIGRAQAQLFLGNGWRVYGVDQSKKPNLTGDFHFLQQDLTLALQSVFNWCPQVDVLCNTVGVLDDYKPLLEQTAQEIQEIFEINYVTPVELTRYYLTQMLKKNSGIIINMCSIASSLAGGGGHAYTSSKHALAGFTKQLALDYAEQGVQVFGIAPGAVKTGMTAADFEPGGLAQWVADETPIKRWIEPEEVAELTLFLASGKAQSMQGEIVKIDGGWSLK

SEQ ID NO: 1573 - protein, 266 aa, Artificial Sequence
  Synthetic
VSNISATGAEFEGKSVVVTGAGAGMGREITIGFLKQGATVIAVDINKGALDKMREELQEEYSTEVVDRFVPFAGDISKQETNEAMIDRAVEATGNIDVLVNNAGIAGHSEPITETSNEDWNRIMEVNLNGPMYAIRAAVRKMLDQSNGGSIVTIASVAGIKGCRSSVAYSVAKHGLVGLCEHTAYAYMHQGIRSNIVCPGAIRTGMSSKPELESEFGRQRIMSGMDPQFVFGETGDIAEAVLFLAGDRAKFVNGATLVVDGGISCN

SEQ ID NO: 1574 - protein, 252 aa, Artificial Sequence
  Synthetic
MGLLTGKTALVTGAARGIGKAVAMKFASEGANIAFTDLVLNDDMAAGLEATRKEIEALGVTCRAYAGNAADFEETEKTVKQIHADFGSIDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTAQLPEEIRKDWMKKIPLRRGGQTEDIANVCLFLASDMSSYVSGQVIQIDGGMNM

SEQ ID NO: 1575 - protein, 247 aa, Artificial Sequence
  Synthetic
MKRFENRTVVITGANRGLGLEILKQFASEGANIIACMRSEKEETLNTLHAIAEENGISITPIYFDMSDEASVKAGCKEIKAMKMPIDVLVNNAGVPHLAILPFTKMQDVHDVFQVNYFSQLLITQSLCGLLSKSAHGTIVNMASIAGIDGEAGNSVYGATKASMILLTKVLSKELAGKVRVNAVAPGLTETDFAEKMGAKAKESMEQSSLMHRLGNPSEIAKTVAFLASDDASFINGQVIRVDGGVK

SEQ ID NO: 1576 - protein, 232 aa, Artificial Sequence
  Synthetic
MKKYMEWCFMNVFITGANKGIGLAITKKLLNSGYQVIAVSRSVDNLTSMKNTNLIIYQANLENVNEIDQVLEDLKKKGIVINALVNNVGIGLFKEIRDISLEEWEKVIRINLTIPFYLIHSLVDDIGKEPYGKIINIGSDADHMPFENASVYCATKFGLFGMTESLRIELKKKNIGITTISPARVDTYFNNKKPGCRPISLKADDVAEQVYFVLKQRSTCNIEQIKLSSILE

SEQ ID NO: 1577 - protein, 266 aa, Artificial Sequence
  Synthetic
MDRLKDKVAIVTGSTSGIGTGIAKMFGAEGAKVVVCGRNEERGQAVVDDIVANGGEAVFQKVDITKPETIDALFADTKERWGGIDVLVNNAAGMALKDGRVDELSLEDWDAVFASDIRSTFYCIKTVLPYLQEREGGSIINIGSMAACSGDLGSTAYACAKAGVDKLTEYTALQYGKQNIRCNCVRPGLIVTPQNEPRIPQPLKDIFLSNIEVNRYGNPDDIAAICVYLGSDESEYFTGQILTVDGGLNAHVPTVAQFRAMASRTW

SEQ ID NO: 1578 - protein, 252 aa, Artificial Sequence
  Synthetic
MKMQGKSVVVTGASSGMGDAIVRLFVAEGASVVAVARRKERLEALKESLTEAPGTIEIYPGDVSDQSICEGMIDFAVEKFGKLDVLINNAGIMDDMSPIGDATNEKYEKVMAVNMFGPFCAMRKAVNVFLEQGNGGSIVNVASLGGMRTCAGSIYCASKAAVISMTKNTAYMYMKDGIRANAIAPGGIASEIATSMGQPNPNGYGRIQPVLACGPEPGSTEEIAKAALFLASEDSAYISGDVLVVDGGWNAG

SEQ ID NO: 1579 - protein, 247 aa, Artificial Sequence
  Synthetic
MRLRGKTALITGTNRGIGKSILEKFAQEGANIFAHARVQNCEFEKHLKEIADKYGVAIVPLYFDLTDTEKLKNVLYELVKSKAPVDVLVNSAGKEHGGFFQMTNIATIKDIFEINLFAQMQITQIMMKTLLKQKNGSIINISSVSGIDLPEGNSAYGVSKAAFIAFTRVLAAECGRFNVRVNTIAPGLIDTDMFRKIEDKAKKGLIARSSLNRLGNPDEVANLAVFLASDESSFVNGQVIRIDGGMV

SEQ ID NO: 1580 - protein, 232 aa, Artificial Sequence
  Synthetic
MTKRVLITGVSSGIGLAQARLFLEKGYQVYGVDQGADPQLPGAFHFLQRDLTLDLTPIFDWCPEVDVLCNTAGVLDDYKPLLEQSAQEIQEIFEINYVTPVELTRHYLTQMLDKKQGIILNMCSIASSLAGGGGHAYTSSKHALAGFTKQLALDYAEAGIQVFGIAPGAVKTAMTAADFEPGGLADWVASETPIKRWIDPDEVAEVSLFLASGKVSAMQGQVLTIDGGWSLK

SEQ ID NO: 1581 - protein, 266 aa, Artificial Sequence
  Synthetic
MAILDKFSLEGKIALVTGASYGIGFAIATAYAEAGATIVFNDIKQELVDKGLAAYEEKGIKAHGYVCDVTDEEQVNELVAKIEKEVGVIDILVNNAGIIKRIPMCEMKASEFRQVIDVDLNAPFIVSKAVIPSMIKKGHGKIINICSMMSELGRETVSAYAAAKGGLKMLTKNIASEYGEYNIQCNGIGPGYIATPQTAPLREVQPDGSRHPFDQFIIAKTPAARWGQAEDLQGPAVFLASDASDFVNGHVVYVDGGILAYIGKQP

SEQ ID NO: 1582 - protein, 252 aa, Artificial Sequence; identical to SEQ ID NO: 1574
  Synthetic

SEQ ID NO: 1583 - protein, 247 aa, Artificial Sequence
  Synthetic
MLLDGKIALVTGASRGIGRAIAIELAKEGATVAINYAGNKTAAEEVKNIITEMGGKAMIIQADVSDENSAMNMVEEVIKEFGGIDILVNNAGITRDGLFIRMKEDDWNAVINTNLTGIFNCTKVAAKYMMKKRSGKIINMSSVSGIMGNAGQTNYAAAKAGVIGFTKSLAREMASRGITVNAVAPGFIATDMTAAMPEKAQEHVLASIPLGKMGEPKDIANAVLFLASDKASYITGQVIHVDGGMVM

SEQ ID NO: 1584 - protein, 232 aa, Artificial Sequence
  Synthetic
MTKRVLITGVSSGIGLAQARLFLEKGYQVYGVDQGADPQLSGDVHFLQRDLTLDLAPIFDWCPQVDVLCNTAGVLDDYKPLLEQSAREIQEIFEINYVTPVELTRHYLTQMLEKKQGIIINMCSIASSLAGGGGHAYTSSKHALAGFTKQLALDYAKAGIQVFGIAPGAVKTGMTAADFEPGGLADWVASETPIKRWIEPEEVAEVSLFLASGKASAMQGQILTIDGGWSLK

SEQ ID NO: 1585 - protein, 266 aa, Artificial Sequence
  Synthetic
MDLSAFDLKGKVALITGGAHGIGFSIAEGMAKCGAAICFNCSSEASLEKGMAAYKAAGIEAHGYVADVSDEDAVNAMVAKIKAEVGPVDILVNNAGLMKRVPMVEMSHADFMRVIDVHVGGAFNCSKAVLPDMMEKHEGKIINICSMMSELGRETVSAYAAAKGALKMLTKNIASEYGEYNIQCNGMGPGYIATAQTAPLRETQPDGSRHPFDQFITAKTPAGRWGEAEDMVGPCVFLASHASDFVNGQILYADGGILAYIGRQPK

SEQ ID NO: 1586 - protein, 252 aa, Artificial Sequence
  Synthetic
MNDKTVIVTGASQGSGRAIAEAFLEASYTVVGLSRRRPEWGAEYGARFIPFSCDVSVEAEVERTFAAAEEAVGAPIRVLVNNAGISSASPIQTDTLAHWNQEFAVNATGVFLCTRHVVRRLVECGLPGRIINISSIAGRSAFPNLSAYSASKAAVIGFTRSLAVELGRHDITVNAICPGSVETEMFRDVLQRLAAESGKTLEAITREQTSVIPLCRFQQPEDVAALALFLASDGARNISGEAINLDGGVVRC

SEQ ID NO: 1587 - protein, 247 aa, Artificial Sequence
  Synthetic
MLKGKNVIVTGATRGIGREIALTLAQNGANIAMNYRNLNSEVEDLINEIKSFGVDALAIKCDVSITEEVDNFVKEVKAHYNTIDVLVNNAGITKDGLILRMKEADFDDVLDVNLKGTFNTTKSVSSIMVRQKYGKIINISSVVGIAGNAGQCNYAASKAGVIGFSKSIARELASRNINVNVVAPGYINTDMTKNLPDKVKEEIIKSIPMKKIGDPKEVANLVLFLSSNLSDYITGQVINVDGGMVMA

SEQ ID NO: 1588 - protein, 232 aa, Artificial Sequence
  Synthetic
MTKTVLVTGVSSGIGRAQAQLFLGNGWRVYGVDQSKKPNLTGDFHFLQQDLTLALQSVFNWCPQVDVLCNTAGVLDDYKPLLEQSAQEIQEIFEINYVTPVELTRYYLTQMLKKQSGIIINMCSIASSLAGGGGHAYTSSKHALAGFTKQLALDYAEAGIQIFGIAPGAVKTKMTAADFEPGGLADWVAEKTPIKRWIEPEEVAELTLFLASGKAQSMQGEIVKIDGGWSLK

SEQ ID NO: 1589 - protein, 266 aa, Artificial Sequence
  Synthetic
MDLSAFNLQGKVALITGGAHGIGFSIAEGMAKCGATICFNCSSEASLEKGLAAYQAAGIEAHGYVADVSDEDAVNAMVAKIKAEVGSVDILVNNAGLMKRVPMIEMSHADFMRVIDVHVGGAFNCSKAVLPDMIEKRAGKIINICSMMSELGRETVSAYAAAKGALKMLTKNIASEYGEYNIQCNGMGPGYIATAQTAPLRERQPDGSRHPFDQFITAKTPAGRWGDPEDMVGPCVFLASHASDFVNGQILYADGGILAYIGRQPK

SEQ ID NO: 1590 - protein, 252 aa, Artificial Sequence
  Synthetic
MDKIVFITGASSGIGAGCARKFASQGASLILNARNEEKLSALKEELEQQYGARVCLLPFDVRDRKTAAEALASLPDEWKAIDILINNAGLVIGVDKEHEGNLDEWDIVIDTNIKSLLAMTRLVVPGMVARGRGHIINIGSIAGDAAYAGGSVYCATKAAVKALSDGLRIDLVDTPLRVTNIKPGLVETNFSVVRFRGDKDKADNVYKGIRPLTGDDIAETVYFAASVPEYMQIAEMLVMPTYQATGTIVSRN

SEQ ID NO: 1591 - protein, 247 aa, Artificial Sequence
  Synthetic
MKKLENKTAIITGASSGFGRATAIAFAKEGCNLVLTARREERLLEVSKECKKFGVKAVFYAGDATLEQTAIECVNLAISEFGKIDILINNAGIGRYLPLLDCTMADYDLIMNTNVRSAFAFTRYTIPEMLKNKSGQIIMVSSAAGIYGYPNETIYASSKFALRGLAQSLDKEFRKDGIKSCAFCPGAGITEFAIGHGRTQEQMANSGMLSAEDVACALIFICTQSEHSRIMEIRMRAMNEPLTGPGC

SEQ ID NO: 1592 - protein, 232 aa, Artificial Sequence
  Synthetic
MTKRVLITGVSSGIGLAQACLFLEKGYQVYGVDQGADPQLPGDFHFLQRDLTLDLTPIFDWCPEVDVLCNTAGVLDDYKPLLEQSAQEIQEIFEINFVTPVELTRHYLTQMIENKRGIIINMCSIASSLAGGGGHAYTSSKHALAGFTKQLALDYAEAGVQVFGIAPGAVKTGMTAADFEPGGLADWVASETPIKRWIDPSEIAEVSLFLASGKASAMQGQILTIDGGWSLK

SEQ ID NO: 1593 - protein, 266 aa, Artificial Sequence
  Synthetic
MGHLTGKTAIITGGGRAVLSDGSCGSIGYGIATAYAKEGANLVITGRNVKKLEEAKEELERLYGIKVLPVQADVSAGADNETVVNNVIKQAVDTFGRIDVLINNAQASASGVTIEDHTTEQFDLAIYSGLYAAYYYMKACYPYLKETKGTVINFASGAGLFGNYGQCSYAAAKEGIRGLSRVAATEWGKDGINVNVVCPLAWTAQLENFEKAYPDAFKANVKMPPMGHYGNVETEIGRACVGLASPDFKYLSGETLTLEGGMGLRP

SEQ ID NO: 1594 - protein, 252 aa, Artificial Sequence
  Synthetic
MKLENKVAIVTGAGSGMGKAIAGLFAKEGAKVIASDINETGVKDLIASSGDIAGEIVFSQTDVSNRNQVETMIDLAVNKYGKLDVLVNNAGVLDKMYSVTEVEDEFWDKVMSININSVMYACRKAIPIMMKNGGGSIINTASVGGLFGCRAGAAYTASKFAVVGLTKNIGFMYAKEGIRCNAICPGSIITNIAAGLSNASEFGIARSGAGVPLSPRMGQPEEIANTALFLASDESSFINGTTVTVDGGWTAY

SEQ ID NO: 1595 - protein, 247 aa, Artificial Sequence
  Synthetic
MKLEGKKALVTGASRGIGRAIALALAAEGADVVVNYAGSEAAAKAVAAEIEAMGRKALVLQADISSNESATAMVDAAVKEFGRIDILVNNAGITRDGLLMRMKEEDWDAVLTTNLKGVFNCTKAAVKYMMKQKAGRIVSISSVVGLMGNAGQANYAAAKAGVLGFTKAVAKEVAARGITVNAIAPGFIQTDMTAVLSEKVVEGMLNTIPLHKLGDPEDIAKAVVFLVSDDAKYITGQTLHVDGGMVM

SEQ ID NO: 1596 - protein, 232 aa, Artificial Sequence
  Synthetic
MTKRVLITGVSSGIGLAQARLFLEKGYQVFGVDQGADPQLPSGFHFLQRDLTLDLTPIFDWCPEVDVLCNTAGVLDDYKPLLEQSAQEIQEIFEINYVTPVELTRHYLTQMMEKKQGIIINMCSIASSLAGGGGHAYTSSKHALAGFTKQLALDYAEAGIQVFGIAPGAVKTGMTAADFEPGGLADWVASETPIKRWIEPSEIAEVSLFLASGKASAMQGQILTIDGGWSLK

SEQ ID NO: 1597 - protein, 266 aa, Artificial Sequence
  Synthetic
VIVMVAVITGASGGIGRETARVLLSKGWRVICLQRHDCDLKGAENIKCDITNQSDIDSALSKIDKIDLLINNAGFGVSGSVEFTDMSEIRSQFELNFFAHIAVTKAALPKLRESRGRIIFISSAASVFSIPFQSFYSATKSAAESVALALSNELKQFGVSVCAIRLGDVKTGFTASRKKNFEGDDVYGGIIARSVAVMENDEINGMKPQYVAEQIVKIAQKKRLPVIATVGGKYKVFCLLQKILPAGFVNKIVGIMYMPKNEQVKF

SEQ ID NO: 1598 - protein, 252 aa, Artificial Sequence
  Synthetic
MTIENKVVVIAGASSGIGAATAKLLASKGAKLVLGARREERLAEIASEIGGDNVIYQATDVTDKDQVKALIDLAVEKFGRLDVLYNNAGIMPREKLADAKFENWEKEININIMGVLHGIAAALPIMQEQNDGLIITTDSVAGHVVYPESAVYNGTKYAVRAIMEGLRQEERLHGIRSTIVSPGSVGTELMSTLDNPEMQAAMDEMFKHVSQEEMRMNVLDPEDIANAVAYVVDQPKHVSITDMIIRPTAQEV

SEQ ID NO: 1599 - protein, 247 aa, Artificial Sequence
  Synthetic
MNKNAFITGGSRGIGKAIVYELSNRGYNICFTYLSNKELSDIIINDLKVMYPKQLFLAVQCDVSNHTSCQDAISIAYMFFNNKIDILINNAGIIRDSMLYILNKSDWDEVINTNINGLYNMTHSLVFDMIKKRQGVIINISSVAGIYGNVGQTNYSTSKAGIIGFTKTLSKEVGNFGIRVNAVAPGFIDTEMAHSLNEKKIKDLSKNISLNRPGKAIEVAKVVAFLCSDDSSYITGQTIIVDGGLSL

SEQ ID NO: 1600 - protein, 232 aa, Artificial Sequence
  Synthetic
MKIHRRRSVETETLYVVLAVREDKRREVLGIFNKPTESALGWGEMSAELHERGMQQTLDSLGDIDILVNNVGISPFKPLTELSIEEFDWVIATNLRPVFITSRQLALHRQQNGNHSYGRIINLCSTRYLQSEAGTAAYSASKGGIYSQTHSLAVSLAPFHITVNAIAPGWIHVCEEEQLRPEDHAFTPRGRVGTPEDIARTCLSLCDEANDFINGQMLTVDGGATIRMIYPE

SEQ ID NO: 1601 - protein, 266 aa, Artificial Sequence
  Synthetic
MDLSAFDLKGKVALITGGAHGIGFSIAEGMAKCGAAICFNCSSEASLEKGMAAYKAAGIEAHGYVADVSDEDAVNAMVAKIKAEVGPVDILVNNAGLMKRVPMIEMSHADFMRVIDVHVGGAFNCSKAVLPDMMEKREGKIINICSMMSELGRETVSAYAAAKGALKMLTKNIASEYGEYNIQCNGMGPGYIATAQTAPLREVQPDGSRHPFDQFITAKTPAGRWGEPDDMVGPCVFLASHASDFVNGQILYADGGILAYIGRQPK

SEQ ID NO: 1602 - protein, 252 aa, Artificial Sequence
  Synthetic
MNRLKGKIAVITGGNSGVGAATAKLFAAEGATVVITARREAALKEVADEITAAGGEVYAVSTDISKSEDPEMLMQKVMDKYGKIDILVNNAGILEQGLKPIDKFLDEDMDRIIETNEKGTMRCMRAASKRMTTGGAIVNVASVAGEKGCGGAAYVASKAAVIGLTKHTALRFQKDGIRCNAICPGNIITPMTMGTDPKALDPDMIGAMMTHSDIKAQSCTAEDVANVVLFFASDEARAITGQIIVTDFGAML

SEQ ID NO: 1603 - protein, 247 aa, Artificial Sequence
  Synthetic
MEFKNKTVIITGAASGMGKLSCERFAKEGANIVMLDVNEEALKKQENELKDKGFNALGIVCNVRNYYEIENAVKTAKETYGTVDVTISYAGGFPGRIFNEAVPFGKRSIESLDWGVDVNFKAPLYMARAVVDIMKEQKSGVIINIGSIDGVTGSATVDYSSEKAGLIGLTKSIALYGADSNVRCCMVSPGPVMTRPGMANMRTPLGRAAEPIEVVDLVMYLASGKAAFISGDNYLVDGARACAAGIY

SEQ ID NO: 1604 - protein, 232 aa, Artificial Sequence
  Synthetic
MTRTILVTGVSSGIGLAQAQLFLENGWRVYGVDRSEKPSLTGDFHFFQQDLILGFQPIFDWCPQVDVLCNTAGVLDDYKPLLEQSAQEIQEIFEINYVTPVELTRYYLTQMLKKQSGIIINMCSIASSLAGGGGHAYTSSKHALAGFTKQLALDYAEQGVQVFGIAPGAVKTSMTAADFEPGGLAQWVADETPIKRWIEPEEVAELTLFLASGKAQPMQGEIVKIDGGWSLK

SEQ ID NO: 1605 - protein, 266 aa, Artificial Sequence
  Synthetic
MITDKSFRLDGKVALITGASYGIGFAIASAYASMGATIVFNDINEELMQKGMAAYKEAGIPAHGYVCDVTDEAAVQAMVAQIEKEVGVIDILVNNAGIIKRIPMLEMSADEFRKVIDVDLNAPFIVSKAVIPGMLKKGAGKIINICSMMSELGRETVSAYAAAKGGLKMLTRNICSEYGEANIQCNGIGPGYIATPQTAPLRERQPDGSRHPFDQFIIAKTPAARWGTTEDLMGPAVFLASEASDFVNGHVLYVDGGILAYIGKQP

SEQ ID NO: 1606 - protein, 252 aa, Artificial Sequence
  Synthetic
MERFLENKVCIITGAAQGIGKSIADRFAGDGAIVYACDRQEGSMDVWAEQCAAAQGTRVIPLYFDVTDAAAVKSAFMSIFKREGRIDVLVNNAGVVFNKKIGMIVRPETELMFRVNVIAVIEMVQLVSRLMARNGGGSIVNIASVTAVLGSPGQSAYSATKGAIMSFTKSAAKELAPLGIRVNAVAPGIVKTERFSELYEESGEKIDTRIQKIALGRLGTPEDVANACAFLASDRASYISGQILGVDGCASI

SEQ ID NO: 1607 - protein, 247 aa, Artificial Sequence
  Synthetic
MLLTDKTAVVTGGSRGIGRAIAVALAAEGAKVAVIYAGNAAAAEETLSLIKEQGGEAVAMQCDVADDAAVSDMINAVKEQFGSVDILVNNAGITRDGLLMRMKEGDWQAVLDTNLTGVFHCTKAVTKLMMKQRSGAIINITSVVGQTGNAGQANYAAAKAGMIGFTKSVAKELASRGIRVNAVAPGCIDTDMTAVLSDAVKEDMLKSIPLGRVAQPEEVAKAVVFLASDNASYITGQVLNVDGGMVM

SEQ ID NO: 1608 - protein, 232 aa, Artificial Sequence
  Synthetic
MTKEVLITGVSSGIGLAQARLFLEKGYQVYGVDQGADPQLAGDFHFMQRDLTLDLTPIFDWCPEVDVLCNTAGVLDDYKPLLEQSAQEIQEIFEINYVTPVELTRYYLTQMLENKKGIIINMCSIASSLAGGGGHAYTSSKHALAGFTKQLALDYAEAGVQVFGIAPGAVKTGMTAADFEPGGLADWVASETPIKRWIDPSEIAEVSLFLASGKASAMQGQILTIDGGWSLK

SEQ ID NO: 1609 - protein, 266 aa, Artificial Sequence
  Synthetic
MSDWLGLDGKTIVVTGGSSGIGAAIVKELIHNGANVVNGDLKEGDLKDPKLTYVHTDVTDPEAVENLAATAEKINGEIWGVVNNAGINKPRILVDPKDPHGKYELNVPTFEQIFSVNVKSVFLVSQAVVRRMVKQGHGVVVNMSSEAGLEGSVGQSVYSASKGAINGFTRSWAKELGKYNIRVVGVAPGIMEATGLRTPSYEEALAYTRDTTVEAIRAGYRSTSTTPLGRSGKLSEVADLVNYFLSNRASYITGVTTNVAGGKSRG

SEQ ID NO: 1610 - protein, 252 aa, Artificial Sequence
  Synthetic
MQQENEMLSGKTAVVTGASRGIGRAIAEKLAAEGAFVVINYNGSKEAAETVLAGIRAAGGDGCVMQCNVSDFAACEAWMKEILALYGKIDILVNNAGITKDGLLMGMSEEAFDRVIETNLKGTFNCIRFAARPMIRQKSGCIINMASVVGVAGNAGQANYAASKAGVIGLTKTAARELASRGIRVNAIAPGFIETDMTEVLSDKVKEASVSQIPLGHFGKPEDVANLAAFLASEAAAYITGQVIHCDGGMVI

SEQ ID NO: 1611 - protein, 247 aa, Artificial Sequence
  Synthetic
MNLKDKIAIVTGGGRGIGKGICLKFASLGANLVINYAGDTAKAEETKAECEKLGAKVVLSQGDVSEMEYCETLFRTAIDTFGRIDILVNNAGITRDNLLMRMSEEEFDKVISVNLKGTFNCMKQAARPMMKQKYGKIINMSSVVGVTGNAGQVNYAASKAGVIGMTKSMAKELANRGVTVNAIAPGFIRTAMTDVLSDDVKADITRAIPMGVMGETEDVANVAAFLASDASRYITGQVINVDGGMVM

SEQ ID NO: 1612 - protein, 232 aa, Artificial Sequence
  Synthetic
MTKVLITGVSSGIGLAQARLFLKNGCAVYGVDKSEAPDIQEENFHFLQLDITGNLAALFDVVPDVDILCNTAGILDAYKPLLAISDDEIADVFQTNFFATVAITRHYLAKMVERQAGIIINMCSIASFMAGGGGAAYTASKHALAGFTRQLALDYAKDKVQVFGIAPGAVKTAMTASDFEPGGLADWVAQETPIGRWSSPDEIAELTGFLASGKASSMQGEIVKIDGGWSLK

SEQ ID NO: 1613 - protein, 266 aa, Artificial Sequence
  Synthetic
MDLGLTGKTVVVTGGSKGIGYAAAEAFLKEGASVAICSRHEEELKKAAETLSQYGPVYYEAYDVVDAESNYRFAEHVNEKFGSLDVWVNNVGVSAPKKGDEYDDEEIDFMTGVCFKSVVYGCQAAFRYMKKQHSGAIVNVSSLAARCPSAGRSTLYGPLKSAINNLTNTFAGEYCPYNVRVTCIMPGFTLTPAVKQTISPEELSMNTQATLLRRAAMPEEIARPIVFLASSAASYMTATTIEVSGGRSMTLNPSFAYDRLAAAENR

SEQ ID NO: 1614 - protein, 252 aa, Artificial Sequence
  Synthetic
MILDLEGRRAVVTGGSRGLGYGIAQALHDSGAEVIITGRTGKVWEAAAEIGSSGPPAYGVTGDLSRQQQRETVCEQILEIYNGRVDILVNAAGTLNRCAAFEVTQEDWNEVVELNLNAVFFMSQIIGRSMAARRYGKIINIASMDSFFGSVLVPAYSASKGGVAQLTKALSNEWAAEGINVNAIAPGYMATALTDTMKVKNPAQYEETTRRIPMGRWGTAEDLKGLAVFLASDASAYISGAVIPVDGGFLGR

SEQ ID NO: 1615 - protein, 247 aa, Artificial Sequence
  Synthetic
MENIEKTALVTGASRGIGRAIALALASKGFAVALNYAGSHDAAEAVKKEIEDAGGKAFTVQGDVSKSEDVDRIFKTVKDEFGGLDVLVNNAGINRDALLIRMKESNWDDVIATDLKSDFLTTKAAAAMMMRKRKGSIINISSVVGIMGNIGQANYAAAKAGVIGLTKACAKEMAARNIRVNAVAPGFIETAMTDGIPEKIREGMISSIPMGRMGQPEDIAKAVCFLASDDSSYITGQVLVVDGGLVM

SEQ ID NO: 1616 - protein, 232 aa, Artificial Sequence
  Synthetic
MTKRVLITGVSSGIGLAQARLFLEKGYQVYGVDQGADPQLAGDFHFLQRDLTLDLTPIFDWCPEVEVLCNTAGVLDDYKPLLEQSSREIQEIFEINYVTPVELTRHYLTQMLENKKGIIINMCSIASSLAGGGGHAYTSSKHALAGFTKQLALDYAEAGVQVFGIAPGAVKTGMTAADFEPGGLADWVANETPIKRWIEPEEVAEVSFFLASGKASAMQGQILTIDGGWSLK

SEQ ID NO: 1617 - protein, 266 aa, Artificial Sequence
  Synthetic
MDLLNLNFFTIHGGNDMSETILVTGASAGFGQAICRRLVADGYRVIGSARRIEKLQALQEELGEAFYPLQMDVTDLSQVDHALASLPKAWEKVDVLVNNAGLALGLAPAYEAEVADWLTMIQTNIVGLTYLTRKILPQMVERNDGYIINLGSTAGTVPYPGANIYGASKAFVKQFSLNLRADLAGKKIRVSNIEPGLCEGTEFSSVRFKGDEKRVEALYRDAHAIQPEDIANTVAWLIQQPKHVNVNRIEIMPVSQTFGPQPVYRD

SEQ ID NO: 1618 - protein, 252 aa, Artificial Sequence
  Synthetic
MRLENKVAVVTGASSGMGKAITTRFVQEGAKVVAVARRIERLEELAESLKGEPGEIEIFSADITSVDKNNEMIDFAVEKFGHLDILVNNAGIMDDMSPVGDMTDEMLDRVMKINGYAPIYAMRKAVQVFLKQEKGGNIINVTSVGVDHNTAGAAYAASKAAVAAVSRNVTFQYMSQKIRCNNIAPGGISTEISKSMGMPNMVGFGNVKKLLGIAPEMGSAEDIANAALYLASDESKYVNGAVITVDGGWTCL

SEQ ID NO: 1619 - protein, 247 aa, Artificial Sequence
  Synthetic
MQFSGKNVLITGASKGIGAEIARVLAKFGLKVWINYRSKPELADALKEEIEKEGGVVALIKFDASKEEDFANAVKLIVESDGELSYLVNNAGITNDKLALRMSLEDFNFVVDTNLNSAFLGCKEALKVMSKKRFGAVVNIASIVGEMGNMGQVNYSASKGGMIAMTKSFAKEGASRNLRFNCVTPGFILSDMTENLSEEVKKNYEENIPLKRFAKPCEVANCVAFLLSDYASYVTGDVLKINGGLYM

SEQ ID NO: 1620 - protein, 232 aa, Artificial Sequence
  Synthetic
MTKRVLITGVSSGIGLAQAQLFLENNYQVYGVDQGENPLLQGDFHFLQRDLTLDLEPIFDWCPCVDVLCNTAGVLDDYKPLLEQTTQEIQEIFEINYMTPVELTRYYLTQMLENKKGIIINMCSIASSLAGGGGHAYTSSKHALAGFTKQLALDYAEAGIQVFGIAPGAVKTAMTAADFEPGGLADWVASETPIKRWIEPEEIADISLFLASGKASAMQGQILTIDGGWSLK

SEQ ID NO: 1621 - protein, 266 aa, Artificial Sequence
  Synthetic
LDKYMSLVGKNIVIMGAGQGIGLAVARLFVKYGGRVAMIDHSGRSFQKAEEIGENAIAFKCDVSEEVQVKKTVNGILKEFRTIDILVNNAAVIVRKNIVDTTAEEWDHAMNVGVRGTFLFSKYILPVMIRQKKGNIINTASNCAVSATPGAASYNAVKGAVASLTRAMAVDHAEDNIRVNCVCPGDVITPMLINEGIQTGKITTGNPQTVEEINAWNAFIKECGSHRPMGRISTPEEIAYTYLYLATDMSGYATGSSVIVDGGRVC

SEQ ID NO: 1622 - protein, 252 aa, Artificial Sequence
  Synthetic
MVVNFMEKLTGKVILVTGASRGIGRAIALELSKQGASIAINCSKDVEGAKKTLDEIISNGGYGKIYIKDISKAINCKELIQDVIKTFGKVDILVNNAGRSKVGLLMDCEDEDIEELINTNLLGAMYLSKYAVTNMISRGSGNIINISSIWGEVGASCEVVYSSSKGGINLFTKALSKEVAPFGIRVNAVAPGVINTEMNNFLDKDEKNSLIEEIPQGRFGDCDEIAKAVSFLCDDNCKYLTGQIIRVDGGII

SEQ ID NO: 1623 - protein, 247 aa, Artificial Sequence
  Synthetic
MLLEGKTAIVTGGSRGIGRVVALAFAQNGANVAVLYAGNEEAAKEVCGQAEEYGVKAKGYRCDVSDFERTGEVVKAVIDEFGGVDILVNNAGIVRDALVLSMKEEDFDAVIATNLKGAFNLIKHTYSHFMRKRRGRIINISSVSGLMGNAGQANYSAAKAGIVGLTKTVAKELAARGVTCNAIAPGFIETDMTGALSDKVKEAANGMIPMKRMGAPEDIAQTALFLASDGARYITGEVIKVDGGLYI

SEQ ID NO: 1624 - protein, 232 aa, Artificial Sequence
  Synthetic
MTKRVLITGVSSGIGLAQARLFLERGYQVYGVDQGADPQLPGEFHFLQRDLTLDLTPIFDWCPEVDVLCNTAGVLDDYKPLLEQSAQEIQEIFDINYVTPVELTRYYLTQMLEKKQGIIINMCSIASSLAGGGGHAYTSSKHALAGFTKQLALDYAESGIQVFGIAPGAVKTAMTAADFEPGGLADWVASETPIKRWIEPEEVAEVSLFLASGKASAMQGQILTIDGGWSLK

SEQ ID NO: 1625 - protein, 266 aa, Artificial Sequence
  Synthetic
MKMSDFRLDGKVALVTGASYGIGFAIASGLAEAGATIVFNDINQDLVNKGLAAYDAAGIKAHGYVCDVTNEDAVNAMVAQIEKEVGVIDILVNNAGIIKRIPMCEMTAAQFRQVIDIDLNGPFIVSKAVIPSMIKKGHGKIINICSMMSELGRETVSAYAAAKGGLKMLTRNICSEYGEFNIQCNGIGPGYIATPQTAPLRERQPDGSRHPFDSFIIAKTPAGRWLEAEELAGPAVFLASDASNAVNGHILYVDGGILAYIGKQPK

SEQ ID NO: 1626 - protein, 252 aa, Artificial Sequence
  Synthetic
MGRLDGKVAVITGGNSGVGAATAKLFAKEGATVVITARREAALKEVADEITAAGGEVYAVLTDISKPEDPEALMQKVMDKYGKIDILVNNAGILEQGLKPIDRFLDEDMDRIIETNEKGTMRCMKAASKRMKSGASIVNVASVAGEKGCGGAAYVASKAAVIGLTKHTALRFQKDGIRCNAICPGNIITPMTMGTDPAALDTDMIGAMMNHSDIKAPSCTAEDVANVIIFFASDEAKAITGQIIVTDYGAML

SEQ ID NO: 1627 - protein, 247 aa, Artificial Sequence
  Synthetic
MLLEGKTAIVTGASGGIGKAVAIALAKEGAAVAVHFHGNEEKALLVKKEIEEAGGKAEIFRANVADFEECNALVKAVAKTFGSIDILVNNAGITRDNLVMKMNDEEFDAVYETNLKGVFHTIHHTSRYFLKQKSGRIINISSVSGITGNAGQANYCAAKAGVIGLTKSVARELSSRGITANVVAPGMIETDMTKDLPDTVKENMLHNIPLGRIGKPEEIAAAVAFLASEEAGYITGQVLAVDGGMTM

SEQ ID NO: 1628 - protein, 232 aa, Artificial Sequence
  Synthetic
MTRRVLMTGVSSGIGLAQARLFLENGYQVYGVDQGENPLLERDFHFLQRDLTLDLEPIFDWCPQVDVLCNTAGVLDDFKPLLEQSAQEIQEIFEINYMTPVELTRYYLTQMLENKKGIIINMCSIASSLAGGGGHAYTSSKHALAGFTKQLALDYAEDGIQVFGIAPGAVKTAMTAADFEPGGLADWVASETPIKRWIEPEEVAEISLFLASGKASAMQGQILTIDGGWSLK

SEQ ID NO: 1629 - protein, 266 aa, Artificial Sequence
  Synthetic
MELKNFSLEGKVALVTGASYGIGFAIACGMAKCGATICFNDIKQELVDKGIAAYKEAGIEAHGYVCDVTDEDAVNALVATIEKEVGVIDILVNNAGIIKRIPMCEMTAAQFRQVIDVDLNAPFIVSKAVIPSMIKKGHGKIINICSMMSELGRETVSAYAAAKGGLKMLTRNICSEYGGANIQCNGIGPGYIETPQTAPLRERQPDGSRHPFDQFIVSKTPAARWGTTEDLVGPAVFLASDASDFVNGHILYVDGGILAYIGKQPE

SEQ ID NO: 1630 - protein, 252 aa, Artificial Sequence
  Synthetic
MGLLTGKTALITGAARGIGKAVAMKFAKEGANIAFTDLVLNDDMKAGLEATRQEIEALGVKCLAYAGNAADFAETEAVVNKIKEDFGSIDVLVNNAGITKDGLMLRMSEAQWDAVLSVNLKSAFNFIHACAPIMLRQRSGSIINMSSVVGVHGNAGQCNYSASKAGMIGLAKSIAQELGPKGVRANAVAPGFIETAMTAQLPEDIRKDWMKKIPLRRGGQVEDIANVCLFLASDMSSYVSGQVIQIDGGMNM

SEQ ID NO: 1631 - protein, 247 aa, Artificial Sequence
  Synthetic
MGKLEGKIALITGCNRGIGRAIMQELVTEGADIIACTRKRTDEQDAFYMQCKSEYGVRIYPVYFDLNDENAIRTALKEIHSLKITIDILVNNAGILNTDGLLRLKLEDAHKVMQVNYFAPLQITQGIVKLMLRSKSASIINVASIAALKPTVGNTVYGASKAALISMTTCWAKEFSSAKIRVNAVAPGYLDTDMSTSVDSKVMAQLVDDTSLKRLGTTKEVAKVVSFLASDDSSYIDGEIVKITGGV

SEQ ID NO: 1632 - protein, 232 aa, Artificial Sequence
  Synthetic
MTRRVLITGVSSGIGLAQARHFLENGYQVYGVDQGENPVLDGDFHFLQRDLTLDLKPVFDWCPQVDVLCNTAGVLDDYKPLLEQSAQEIQEIFEINYVTPVEMTRHYLTQMLESKKGIIINMCSIASNLAGGGGHAYTSSKHALAGFTKQLALDYAEAGIQVFGIAPGAVKTSMTAADFEPGGLADWVASETPIKRWIEPEEIADLTLFLASGKANAMQGQILTVDGGWSLK

SEQ ID NO: 1633 - protein, 266 aa, Artificial Sequence
  Synthetic
MAYLDKFSLAGKVALVTGGAYGIGFAIARALAKAGARIAFNCRRQAHLEQALADYRAEGIEAHGYIADVTDEAQVTELVKTIEKELGVVDILVNNAGIIKRIPMIEMSVADFRQVVDIDLTAPFIVAKAVLPGMIQKGHGKIINICSMMSELGRETVSAYAAAKGGLKMLTRNICSEYGGANIQCNGIGPGYIATPQTAPLREKQPDGSPHPFDQFIIAKTPAARWGTPEDLEGPAVFLASDASDFVNGHILYVDGGILAYIGKQP

SEQ ID NO: 1634 - protein, 252 aa, Artificial Sequence
  Synthetic
MDRLKGKVAVITGGNSGVGEATAKLFAKEGAVVVITARREAALTKVAEEIKAAGGEAFAVSTDISKPEDPERLMELVLKKYGKIDILINNAGILETGLKPIDRFLDEDLDRIVETNQKGTMRCMRAAARRMQSGASIVNVASVAGVKGCGGAAYVASKAAVIGVTKHTALRFQQTGIRCNAICPGNIITPMTTGTDPAVLDPDMIGAMAAHSNLKTPSCTAEDVANVILFFASDESRAITGQVIVTDFGAML

SEQ ID NO: 1635 - protein, 246 aa, Artificial Sequence
  Synthetic
MDFTNKTVLVTGSSRGIGKAIAVAFGRAGARVVLNASRSKDQLEETKKEMEEMGVSCMAVLADVSDYNACKDMFLQIQDAFGPVDILVNNAGISHIGLFTDMTPEQWQHVLNVNLGSVLNCTHLAVPAMVHNKTGVILNISSMWGEAGASCEAVYSVSKGGINAFTKAMAKELGPSGIRVNAIACGVIDTEMNACFSEEERAELADEIALMRFGKPEEVGRFALTLASESASFLTGQIITLDGGML

SEQ ID NO: 1636 - protein, 232 aa, Artificial Sequence
  Synthetic
MTKRVLITGVSSGIGLAQARLFLEKGYQVYGVDQGADPQLAGDFHFLQRDLTLDLTPIFDWCPEVEVLCNTAGVLDDYKPLLEQSAQEIQEIFEINYVTPVELTRHYLTQMLEKKQGIIINMCSVASSLAGGGGHAYTSSKHALAGFTKQLALDYAEAGIQVFGIAPGAVKTGMTAADFEPGGLADWVASETPIKRWIEPEEVAEVSLFLASGKASAMQGQILTIDGGWSLK

SEQ ID NO: 1637 - protein, 266 aa, Artificial Sequence
  Synthetic
MDLTAFDLKGKVALVTGGAHGIGFSIAEGMAQCGATVCFNCSSEASLEKGLAAYKAAGIDAHGYVADVSDEDAVNTMVAKIKAEVGSVDILVNNAGLMKRVPMIEMSHADFMRVIDVHVGGAFNCSKAVLPDMMEKRAGKIINICSMMSELGRETVSAYAAAKGALKMLTKNISSEYGEYNIQCNGMGPGYIATAQTAPLREIQPDGSRHPFDTFICAKTPAGRWGTPEDMVGPCVFLASHASDFVNGQILYADGGILAYIGKQPK

SEQ ID NO: 1638 - protein, 252 aa, Artificial Sequence
  Synthetic
MGLLTGKTALITGAARGIGKAVAMKFASEGANIAFTDLVLNDDMAAGLEATRKEIEALGVTCRAYAGNAADFEETDKTVKQIHADFGSIDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTAQLPEEIRKDWMKKIPLRRGGQTEDIANVCLFLASDMSSYVSGQVIQIDGGMNM

SEQ ID NO: 1639 - protein, 246 aa, Artificial Sequence
  Synthetic
MLEGKTAVVTGAGRGIGRAIALRLAAEGANVIVNYNGSAKRAEEVVNEITAGGGHAEAIQCSVSDFESVAAMMDGVIKKYGSIDILVNNAGITKDNLLMKMSEGDFDAVIDTNLKGVFNCMKHVARQMIKQRGGRIINISSVSGVLGNAGQANYCAAKAGVIGLTKSFAREVASRGVTVNAVAPGFIETEMTEVLSDAVKAGATEQIPMKHFGTTEDIAGAVAFLASGAAGYITGQVICVDGGMAM

SEQ ID NO: 1640 - protein, 232 aa, Artificial Sequence
  Synthetic
MTKRVLITGVSSGIGLAQARLFLEKGYQVYGVDQGADPQLPGAFHFLRRDLTLDLTPIFDWCPEVDVLCNTAGVLDDYKPLLEQSAQEIQEIFEINYVTPVELTRYYLTQMLEKKQGIIINMCSIASSLAGGGGHAYTSSKHALAGFTKQLALDYAEAGIQVFGIAPGAVKTGMTAADFEPGGLADWVASETPIKRWIEPEEVAEVSLFLARGKASAMQGQLLTIDGGWSLK

SEQ ID NO: 1641 - protein, 266 aa, Artificial Sequence
  Synthetic
METKVVLITGISSGFGLESARMLAETGYTVYGTVRREVEPIPGVHYLNADVRDAESVKRAVDTVIAEQGHIDMLVNNAGMGIGGPIEFTPDEEIELQMDTNFMGMVRFSKAVLPHMRTRKFGKIVFLSSIGGLMGLPFQGFYSASKFAIEGYAEALRMEVHNFRISVSLINPGDFSTGFTGKRRKTATEVAEAYPAYALAMSKIENDEGHGLKPVKVAETVARIAKARRPRNRYVVATFEQSLSVLLKAILPSSLFSKILRGYYKM

SEQ ID NO: 1642 - protein, 252 aa, Artificial Sequence
  Synthetic
MGKIALITGATSGIGEGCARRFARGGYNLIITGRNTGKLEILKKELEAEGTEVLALAFDVRNREAAKKAVDYIPDAWRNIDVLINNAGLARGLEPEYEGDFEDWDQMIDTNIKGLLTMTRLIVPGMIKRNHGHIINIGSVAGDAAYAGGNVYCATKAAVKAISDGLRIDVAHTKVRVTNVKPGLVETNFSNVRFHGDNARADQVYRGITPLNGDDVADVAYYAASAPEHVQIAEVLVLATHQANGTVIHRER

SEQ ID NO: 1643 - protein, 246 aa, Artificial Sequence
  Synthetic
MLSGKVAIVTGASRGIGRETALTLAGYGATVIVNYCGSKDKAEAVVEEITAAGGTAKAYQGDVSDFDVAKEMITSVKKEFGSIDILVNNAGITKDNLIMKMSEEEFDKVIEVNLKGAFNCMKHVSRIMLKQRSGHIINMSSVSGVMGNAGQVNYCASKAGIIGMTKSLARELGSRGITVNAIAPGFIETEMTDVLSEDVKENLLGSIPLKRMGQTKDIAETVAFLASDKAAYITGQTISVDGGMGM

SEQ ID NO: 1644 - protein, 231 aa, Artificial Sequence
  Synthetic
MGKKVLISGASRGIGYAAAAAFAANGYSVTALWHTAPECLELPCAGICPVRCDVSNSASVERLFEQVGDVDVLINNAAISKSVLFTDITEAQWDEMLNVDLKSVFLMTKAFLPGMIRKKNGKIINISSIFGVVGGACEVHYSAAKAGVIGLTKALAKEVGPSGIQVNCIAPGVIDTRMNAGLSEPDMAALREQTPLGRLGTPEDVARLALFLAEDSFITGEVIHTGGGFLR

SEQ ID NO: 1645 - protein, 266 aa, Artificial Sequence
  Synthetic
MDFINMFSLKGKNALVTGASYGIGFEIAKALSNAGATIIFNDVIEENIKKGLAAYKENNINAHGYLFDITDEQSVKENIKKIESDVGIIDILVNNAGIIQRKPMLETTAADYRKIIDIDLTGQFIMAKAVLPSMIKKGHGKIINICSMMSELGRETVVGYASAKGGLKMLTKNICSEFGEKNIQCNGIGPGYIATPQTAPLREIQPDGSRHPFDQFIISKTPAGRWGKPDDLAGAAIFLASDASNFINGHILYVDGGILAYIGKQP

SEQ ID NO: 1646 - protein, 252 aa, Artificial Sequence
  Synthetic
MNRLENKVAVVTGANSGVGAAIAKLFAAEGAVVVMTARREAALEEVAGQIEAAGGKTFVMATDISKAEDPERLMAAVEEKYGKIDVLVNNAGILESGLKPIDRFTDEDLDRIIETNQKGTMRCMRAATKRMSAGASIVNIASVAGEKGCGGAVYVSTKAAVIGVTKHTALRFQAEGIRCNAICPGTIVTPMVAGTTAADMDADMMGAMATHSNLRTQPCMPEDVANIALFLASDESRALTGQILVSDFGAML

SEQ ID NO: 1647 - protein, 246 aa, Artificial Sequence
  Synthetic
MLSGKVAIVTGASRGIGRETALTLAGYGATVIVNYCGSKDKAEAVVEEITAAGGTAKAYQGDVSDFDVAKEMITSVKKEFGSIDILVNNAGITKDNLIMRMSEEEFDKVIEVNLKGAFNCMKHVSRIMLKQKSGHIINMSSVSGVMGNAGQVNYCASKAGIIGMTKSLARELGSRGITVNAIAPGFIETEMTDVLPEDVKENLLASIPLKRMGQTKDIAETVAFLASDKAAYITGQTISVDGGMGM

SEQ ID NO: 1648 - protein, 231 aa, Artificial Sequence
  Synthetic
MRTAVITGTSGGIGTAIALAFAGEGCNVVLQYNKGKDKAEALAEKIQKEYGVIALPVQADISSSQSVKSFFDEVEAKLSNVDVLVNNAGIAQQKLFTDITDEDWHRMIGTNLDGVFYYSREVLNRFMIKNHSGVILNISSMWGQAGASCEVHYSAAKAGVIGLTKALAKEVGLITRRSSVQIRLPQPNKTVFRNRLFFFQFFRKCLKTAYLCGFQTATETSWEKLSQNKYS

SEQ ID NO: 1649 - protein, 266 aa, Artificial Sequence
  Synthetic
MDTNKLFSLEGKIALVTGAAYGIGFAIAEAYAKAGAKIAFNCRSKEHMEKALSDYQEKGIEAKGYLCDVTDEAQVAQMVADIEKELGTIDILVNNAGIIKRIPMTEMKAEEFRQVIDIDLNAPFIVSKAVLPGMMKKGHGKIINICSMMSELGRETVSAYAAAKGGLKMLTKNIASEYGAYNIQCNGIGPGYIATPQTAPLREPQPDGSRHPFDQFIIAKTPQARWGTPKDLMGPAIFLASDASDFVNGHILYVDGGILAYIGKQP

SEQ ID NO: 1650 - protein, 252 aa, Artificial Sequence
  Synthetic
MNRLQDKIAVVTGANSGVGAAIAKLFAKEGATVVMTARREAALEEVASQIESDGGTTFVMATDISKLEDPERLMAAVEEKYGRIDILVNNAGILEKGLKPIDRFSDEDLDRIIETNQKGTMRCMRSATKRMKKGASIVNIASIAGEKGCGGAVYVSSKAAVIGVTKHTALRFQDEGIRCNAICPGTIATPMVAGTTAADMDPDMMGAMATHSNLKTPPCMPEDIANIALFLASDESRALTGQIIESDFGSML

SEQ ID NO: 1651 - protein, 246 aa, Artificial Sequence
  Synthetic
MLEGKIALVTGASRGIGRQIAKTLAAKGATVIVNYNGSAAKAEEAVQEIREAGGIAEAVQCNVSDFNSSKEMLDGIVAKYGRLDILVNNAGITRDNLVMKMSEEDFDAVIQTNLKGVFNCIHHISRQMLKQRSGRIINISSVSGVLGNAGQANYCAAKAGVIGITKSVAREMASRGITVNAIAPGFIRTEMTDVLRDDIKKALMEQIPMKNFGEVEDIANTVAFLASEDARYITGQVISVDGGMAM

SEQ ID NO: 1652 - protein, 231 aa, Artificial Sequence
  Synthetic
MMKRVIVITGGSDGLGKSIAERLAQNEENEVIILSNQQDKLTDAAIETNSDYQVCDVTNHLSVETAVNNILQKYKKIDVLINNAGVWLAGDLTECNYDVISNCIDVNTKGPIYMTKAVLPSMYENKEGLIINVCSQASFDSDDFSTVYNASKWAMRGFNRSIQKDVSKKGIKVTGFYPGFMQTNIFKKAGNDYDTSTGLETEKVAKAIEFIINCDEDVIIPEFGIKDIENY

SEQ ID NO: 1653 - protein, 266 aa, Artificial Sequence
  Synthetic
MAEGTNKVVIVTGGSSGIGRCTASALKENGCIVYEFSRRSIPMEGVTHLFVDVTDEDAVNAAVQQVIQKETKIDAVINCAGFGISGAVEFTSMEQAKAQFDVNFFGTVTVNKAVLPFLRRQGKGHIVNISSVAAVAHIPFQTFYSASKAAVSSYSYALANEVKPYGIHVTVVELGDICTGFTKARQKSILGDDEYGGRISRSVSQMERDEQNGIDPARIGRYIAGIVEKKNPAVVYVAGAQYKFLSLLCKLLPAAARGKIVGKIYG

SEQ ID NO: 1654 - protein, 252 aa, Artificial Sequence
  Synthetic
MLETFNPFTLQGKTIFVTGASAGIGKSIAISCARMGANVVITARNEERLNETLAQLPGENQAIKADLTNGADIEALVAALPKLDGVVHCAGVSYRVPCKMISEENVAQVMRPNFEAPVLLQTAILKAKKINKAASIVFIASRAANAPSIGNAIYSASKGAILSYAKCLALELAPRMIRVNSICPGMVWTNLILMNGISEEKLREAELTYPLKRFGKVEDVANLAIYLLSDASSWMTGSAIDISGGGEGVLTL

SEQ ID NO: 1655 - protein, 246 aa, Artificial Sequence
  Synthetic
MLEGKIALVTGASRGIGRQIAKTLAAKGAFVIVNYNGSAAKAEEVVKEIQAAGGNGQAVQCNVSDFESCKEMLDAVVKEHGRLDILVNNAGITRDNLLMKMSEEDFDAVIQTNLKGVFNCTRHIARQMLKQKSGRIINISSVSGVLGNAGQANYCAAKAGVIGLTKSAAKELASRGITVNAVAPGFIKTEMTDVLKDDIKKAIMENIPMKAFGETEDIANAVAFLASEEARYITGQVISVDGGMAM

SEQ ID NO: 1656 - protein, 230 aa, Artificial Sequence
  Synthetic
MKKVMVITGGSDGLGKSIAEKLAQNEENEVVILSNQQDKLTDAAIETNSDYQVCDVTNHVSVETAINNILQKYKKIDVLINNAGVWLAGDLTECNYDVISNCIDVNTKGPIYMTKAVLPSMYENKKGLIINVCSQASFDSDDFSTVYNASKWAMRGFNRSIQKDLSKKGIKVTGFYPGFMQTNIFKKAGNDYDTSTGLETEKVAKAIEFIISCDDDVIIPEFGIKDIENY

SEQ ID NO: 1657 - protein, 266 aa, Artificial Sequence
  Synthetic
MSDYLNFSLEGKVALVTGASYGIGYAIASAFAKCGAKVVFNDIKQELVDKGLAAYAADGIDAKGYVCDVTDENAVQDMVKKIEEEVGVIDILVNNAGIIKRIPMCDMTAEQFRQVIDVDLNAPFIVSKAVIPSMIKKGHGKIINICSMMSELGRETVSAYAAAKGGLKMLTRNICSEYGANNIQCNGIGPGYIATPQTAPLREKQADGSRHPFDQFICGRTPAGRWLQAEELTGPAVFLASEASNAVNGHILYVDGGILAYIGKQP

SEQ ID NO: 1658 - protein, 252 aa, Artificial Sequence
  Synthetic
MKMQGKSVVVTGASSGMGDAIVRLFAAEGAQIVAVARRKERLEALKESLADAPGTVEIYPGDVSDQALCEGMIDFAVEKFGKLDVLINNAGVMDDMSPIGDATNEKYEQVMAVNMFGPFCAMRKAVNVFLSQGNGGTIVNVASLGGMRTCAGAIYCASKAAVISMTKNTAYMYMKDGIRANAIAPGGIASEIAASMGQPNPNGYGRIQPVLACGPEPGSTEEIAKAALFLASDDSAYISGDVLVVDGGWNAG

SEQ ID NO: 1659 - protein, 246 aa, Artificial Sequence
  Synthetic
MEDKKVALITGGTRGIGKAIAIKFAKNGYNLVLNYVSDRTNLEELENEFKEYNIEVLFIKTDVSNFEDCENMAKQAIAKFGKIDVLVNNAGITKDSLLLRMTPEDFEKVININLKGTFNVTKSIVPYMMKKRTGKIVNISSVVGVSGNAGQCNYAASKAGIIGFTKSIAKELASRNILANCVAPGFIDTDMTSVLSDSVKENINAQIPLKRMGSSEEIANSVYFLAGEENTYITGQVLNVDGGMLM

SEQ ID NO: 1660 - protein, 230 aa, Artificial Sequence
  Synthetic
MKEKIIVITGGASGLGLELVKQSIARGLYVCNIDWNVSKMKELEETYKTGYKGFIGDISDEDFIKDTISEISKLGNIKYLINNAGEPSFKLPCEYSKDDIDKCFKGLQGMIIVSTETLKAKEEKNLKIVNVMSSAALRGNKQEAVYCATKWGEKGYTESLKIAYKGTSVKIIGVYPGGINTNFYKNSRDYISEEKQNSFMNPRDVADTILNNILSPANLTVADIIIERNS

SEQ ID NO: 1661 - protein, 266 aa, Artificial Sequence
  Synthetic
MDLSAFNLQGKVALITGGAHGIGFSIAEGMAKCGAAICFNCSSEASLEKGLAAYKAAGIDAHGYVADVSDEDAVNAMVAKIKSEVGPVDILVNNAGLMKRVPMTEMSHADFMRVIDVHVGGAFNCSKAVLPDMMEKREGKIINICSMMSELGRETVSAYAAAKGALKMLTKNIASEYGEYNIQCNGMGPGYIATAQTAPLREVQPDGSRHPFDQFITAKTPAGRWGDPEDMVGPCVFLASHASDFVNGQILYADGGILAYIGRQPK

SEQ ID NO: 1662 - protein, 252 aa, Artificial Sequence
  Synthetic
MRIIAITGATGGLAKEIVKQLPSDDFVIALGRNVKKLEACYVERPNTVCYELDMSSDEAIGAMVEKLYAEHGYIDVFINNAGYGDFSEFDAYTTAEIRDMFDINTFATMTFSRLVGHKMKKAGYGHIVNIASIAGLIASAKSSVYSATKFAVIGFSNALRLELADSNVYVTTINPGPIATSFFDKADPSGEYLKSVGRFVLQPEEVARRTVAILGKNKREVNMPWSIAAAHKFYTLFPKIADFLARKVFNYK

SEQ ID NO: 1663 - protein, 246 aa, Artificial Sequence
  Synthetic
MLEGKIALVTGASRGIGRQIALALAAQGATVVVNYNGSAAKAEEVVNEITAAGGKAEAIQCNVADFEACAGLMAGILKQYGRLDILVNNAGITRDNLLMKMSEEDFDAVIQTNLKGVFNCVKHVSRQMLKQKSGRIINISSVSGVLGNAGQANYCAAKAGVIGLTKSAARELASRGITVNAVAPGFINTDMTECLSDGVKAAAVEQIPMKHFGETEDVANLVAFLASDAARYITGQVISVDGGMAM

SEQ ID NO: 1664 - protein, 230 aa, Artificial Sequence
  Synthetic
MENKVMVVTGASSGIGYCTALKAQEQGWRVIWASRHIESDKQICAMCNENSECKNLDVSSEDSVRDFFRYVKSRYGKLDALVNCAGFVDPQSLLATSLENWEKTIKINLTGTFLCCKNAVQSMKKRGGKIINISSTAGLTPRPGWSAYAASKSGVISFSEAIAEELAMYNIKVFMICPGRTATPLRKILAPDEDPTTIMQPHTVAKTVLFCLSQEADPMEGQPILVRERF

SEQ ID NO: 1665 - protein, 266 aa, Artificial Sequence
  Synthetic
MFEMSKFSLEGKIALITGASYGIGFAIATAYAKAGATIVFNDINEALVEKGMEAYKAEGIEAHGYVCDVTNEDAVNELVAKVEKEVGTIDILVNNAGITKRIPMLEMSAKDFRQVIDIDLNDPFIVSKAVIPGMIKKGHGKIINICSMMSELGRETVSAYAAAKGGLKMLTRNICSEFGEHNIQCNGIDPGYIATPQTAPLREIQPDGSRHPFDQFIIAKTPAARWGTPDDLMGPAVFLASDASDFVNGHVLYVDGGILAYIGKQP

SEQ ID NO: 1666 - protein, 252 aa, Artificial Sequence
  Synthetic
MGLLTGKTAIITGAARGIGKAVAMKFASEGANIAFTDLVLNDDMAAGLEATRKEIEALGVTCRAYAGNAADFAETEKVVKQIHADFGSVDILVNNAGITKDGLMLRMSEAQWDAVLNVNLKSAFNFIHACSPIMLRQRSGSIINMASVVGVHGNAGQCNYAASKAGMIALAKSIAQELGPKGVRANAVAPGFIETAMTEQLPEEIRKDWMKKIPLRRGGKPEDIANVCAFLASDMASYVSGQVIQIDGGMNM

SEQ ID NO: 1667 - protein, 246 aa, Artificial Sequence
  Synthetic
MLKGKCAVVTGAAKGIGKAIALKLASLGVNIVLNYRSSEDKAIETEKEILSLGVEVLRIKGDISKANDVENLIDSAKKKFGKIDIMVNNAGITKDTLLLRMKEEDFDSVINVNLKGVFNCLKAITPVMVKQKEGKIINLSSVVGLVGNAGQVNYAASKAGVIGMTKSLAKEIGSRGITVNAVAPGFIETDMTDVLGDRFKEEAKKSIPLKRLGKAEDVAEVVAFLASDSANYITGQVIHVDGGMVM

SEQ ID NO: 1668 - protein, 229 aa, Artificial Sequence
  Synthetic
MKKALVTGATSGIGHAIVEKLLELGYFVYGVGRDFSKVNFGENFEGIQCDLFKYQNIESMIRELRKKAEIDLLINSAGVGYFGPHEEINASKLHKMITLNLEAPIILTQLLLRDLKKNKGTIINISSITAKKSSVFGCAYSATKAGLGHFSESLFDEIRKTGVKVVCIYPDITKTPFYDDLNFSQGEDPQSYILPECVAGGVETILSQRDGTVITQLLLQPQKHMIKRK

SEQ ID NO: 1669 - protein, 266 aa, Artificial Sequence
  Synthetic
MDRLKGKVAVVTGSTSGIGIGIAREFAAEGAHVVVCGRREARGQEVVDGIVAEGGSASFHRMDLTDLSTVDALFADTARDHGRIDILVNNAAGVGLKDGRVDEISLEDWDAMFASGVRGTFYSIKAVLPYMIEAGGGSIVNIGSMASISGDLGSTAYACSKAGVDMLTSSVALQYGKQNIRCNCVRPGLIVTPQNEAHVPQQLKDVFLSNIEVNRYGSPADIAHACTYFASDESAYVTGQVINVDGGLNSHAPTVAQFRSAGSRTW

SEQ ID NO: 1670 - protein, 252 aa, Artificial Sequence
  Synthetic
MSLSNPFGLEGKTILVTGASSGIGKAAAIECSKAGAKVIITARNEERLKETHGLLHDCAGQPDYMVTDMQKDDDIVSLVDNLPNLDGVILNAGISINVPIAFIDREKLEQVLGTNTIAPILLTRQLIKKKKVNRGGSLVFTASISGNNTVTVAHEMYSASKAAITGFMKNAALDLAAKGIRCNAVHPGMINTPMVHSGKYSDEQLQRDMDNYPLKRFGEPEEVAYAMIYLLSDAAAWVTGHSLVIDGGLTLK

SEQ ID NO: 1671 - protein, 246 aa, Artificial Sequence
  Synthetic
MGERKTALVTGASRGIGRAIAVRLAKDGCDVAVIYAGNKEAAEETCRMIEESGAKSLAVCCDVSDPQQCKDAVKQVMDTFGSIDILVNNAGITRDALVLSMKEEDFQKVIDTNLNGAFYMIKNTYHAFMKRRKGRIINISSISGVMGNAGQANYAAAKAGLIGMTKSVAKELAGRGITCNAIAPGFIQTDMTAVLSDKVKAAVQEQIPMKKMGLVDDVAAAVSFLAGEESGYITGQVLCIDGGLSM

SEQ ID NO: 1672 - protein, 229 aa, Artificial Sequence
  Synthetic
MKKALVTGATSGIGLAIVKKLLELGYHVYGVGRDFSKISIEENFTPIVCDLLKYQNIEKMVRELEDKREIELLVNCAGVGYFGPHEEINPTKLHKMIALNLEAPLVLTQQFLRILKKNQGTVINISSITAKKSSVFGCAYSATKAGLGHFSESLFDEVRKTGVKVVCIYPDITKTPFYDELDFQEGEDSLSYILPECVAQGVESVINQRPGTVITQLVLQPQKHIIKRK

SEQ ID NO: 1673 - protein, 266 aa, Artificial Sequence
  Synthetic
MDLSAFNLQGKVALITGGAHGIGFSIAEGMAKCGAVICFNCSSEASLEKGMAAYKAAGIDAHGYVADVSDEDAVNAMVAKIKAEVGSVDILVNNAGLMKRVPMIEMSHADFMRVIDVHVGGAFNCSKAVLPDMMEKREGKIINICSMMSELGRETVSAYAAAKGALKMLTKNIASEYGEYNIQCNGIGPGYIATPQTAPLRERQPDGSRHPFDSFIVAKTPAGRWGEAEDLGGPAVFLASAASDFVNGLILYVDGGILAYIGKQPQ

SEQ ID NO: 1674 - protein, 252 aa, Artificial Sequence
  Synthetic
MRFEGKCVVVTGASSGMGRVIALDFAKEGATVIAVARRKERLDELALQSADFAGKILPYPGDVSSEEVCNGMIDFAVEQCGALDILVNNAGIMDEFTPIGEMSNELYERVMAVNLNGPIYAMRKAVQVMLAKETMGNIVNVASIGGVRGCRAGAAYTASKHAIVGVTKNTAYMYAGKIRCNVICPGGVETEVMNSQTNISQLGMGRVMAGLDTAIPAGKPEDISAAVLYAASDDAKFLTGAEIVVDGGVSCN

SEQ ID NO: 1675 - protein, 246 aa, Artificial Sequence
  Synthetic
MLEQKVAVVTGASRGIGRAIAEKLAEEGVFVVINYRGNEEQAKQVQQTIKEQGGNAGIYGCDVSDFSACEAFFKDVIETYGRLDILVNNAGITRDGLLMKMTESDYDAVLQTNLKGTFNGIRFASRQMLRQKSGRIINISSVSGILGNAGQANYSASKAGVIGLTKSAARELASRGITVNAVAPGFIKTEMTEVLSEQVQNHAKSQIPLGSFGNPEDVAEAVWFLASDKAGYITGQVLNVDGGMAM

SEQ ID NO: 1676 - protein, 229 aa, Artificial Sequence
  Synthetic
MKKTVLITGATDGIGKALAILLGKECNLALCGRDESKMRALLQELGDCRVYSECFDITNGEKRHSFCANAKNEFGTVDVLVNNAGANTKKDKIVNINLEDLRYMFELNCVSAVGMIQEIYPLMAEKQQGLIVNILSTCCLFNNPMTGSYSASKDAMEGISKILLKEVKAENIGVCNVYPGGVDSNFRAASKPQYLRPETVAKMIRNCIENEEGCVHDIVIRPFIEDNMA

SEQ ID NO: 1677 - protein, 266 aa, Artificial Sequence
  Synthetic
MDLSAFNLQGKVALITGGAHGIGFSIAEGMAKCGATICFNCSSEASLEKGMAAYKAAGIDAHGYVADVSDEDAVNAMVAKIKAEVGSVDILVNNAGLMKRVPMIEMSHADFMRVIDVHVGGAFNCSKAVLPDMMEKREGKIINICSMMSELGRETVSAYAAAKGALKMLTKNIASEYGEYNIQCNGMGPGYIATAQTAPLREIQPDGSRHPFDQFITAKTPAGRWGEPEDMVGPCVFLASHASDFVNGQILYADGGILAYIGKQPK

SEQ ID NO: 1678 - protein, 252 aa, Artificial Sequence
  Synthetic
MQRTALVTGATAGFGAAICRTLIENGYRVIGTGRRVARLEQLQQELSENFHFLAFDISDRLATEDAFHSLPASWQSIDLLVNNAGLALGLESADKANLDDWMQMIDTNIKGLVTITRLVLPQMVERNSGHIINLGSIAGTYPYPGGNIYGGTKAFIKQFSLNLRADLAGTQIRVTNVEPGLCGGTEFSNVRFKGDDARAQKLYENVEYVSPQDIANIVLWLNQQPEHVNINRIEVMPTAQTFAPLNVARIQK

SEQ ID NO: 1679 - protein, 246 aa, Artificial Sequence
  Synthetic
MLKGKVAVVTGASRGIGRAVALKLASMNATVIVNYAGSKDKAESVVKEIQEMGKTAEAIQCDVSDFEQCSQLMQQVQEHYGRIDILVNNAGITRDGLAMAMKEEDFDDVIATNLKGTFNCIRFASRIMMKQRYGKIINMSSVSGITGNAGQVNYSAAKAGVIGITKSMARELAGRHINVNAIAPGFIETDMTNELSEKVKEQAVGQIPLGRFGKAEEVAELAAFLAGNQSDYITGQVFHIDGGMVM

SEQ ID NO: 1680 - protein, 227 aa, Artificial Sequence
  Synthetic
MKKTIIITGGSDGLGKTLTETFSKENNVIILATNEEKMNLVAKENNCFYKVCDVSNYDVVEKAINEIVKEYNKIDVLINNAGLWIQEELDVNNSNRIKSVIEVNLLGTINVSKAVIPSMKANKDGLIININSQAGINHKAERVVYNASKWGVTGFSKSLQDEVAKYGIRVTDVMPGMMKTEMFSRMNIEKNMVNGLDTKEVARLIQFIIDTPSDVMIPEIGIKNINN

SEQ ID NO: 1681 - protein, 266 aa, Artificial Sequence
  Synthetic
MDRLKGKVAIVTGSTSGIGTGIAKMFGAEGAKVVVCGRNEERGNKVVEDITSQGGEAYFHKFDVTQPETVDALFADTKERWGSIDILVNNAAGMALKDGRVDEISLEDWDAVFASDVRSTFYCIKTVLPYMQEQNGGSIINIGSMASCGGDLGSTAYACAKAGVDMLTEYTALQYGKQNIRCNCVRPGLIVTPQNEAKVPDALKSIFLDNIEVTRYGKPEDIAAMCVYLGSDESSYFTGQVVTVDGGLNAHVATVAQFRALASRTW

SEQ ID NO: 1682 - protein, 252 aa, Artificial Sequence
  Synthetic
MKALVTGASSGIGKDMTKVLAKLNYDLVLVARNKEGLDKVKLELQKENAKINIKTFEMDLNIKENCYKLYEQEKNIDLLINNAGFGLYGEFTETDLEKEINMINTNITAVHILTKLYLKDMVKENKGHILNVASIAGFMPGPLMATYYATKNYVVSLTRAIRKELRKNKSKVKISLLCPGPVDTNFNNVANVKFKIPGLTSEYVAKYAIKKMQKGRLIIIPGTLIKIVRWLTEITPDVIVEEFSYHTQTKKR

SEQ ID NO: 1683 - protein, 246 aa, Artificial Sequence
  Synthetic
MLTNKTALVTGASRGIGAAIAKSLAKEGAFVIINYNGSKERADAVAAEIIADGGKAAVYGCNVSDYSACEKMAKDIMETYGHLDILVNNAGITRDDLLMKMSEEAFDAVIATNLKGTFNTIRHFSRYLLKQRSGTIINLSSVSGILGNAGQANYSASKAGVIGLTKSVARELSSRGITCNAVAPGFIDTEMTAQMTDKAKEAVQAQIPLGRVGKVDDIAEVVTFLASEKASYITGQVISVDGGMSI

SEQ ID NO: 1684 - protein, 227 aa, Artificial Sequence
  Synthetic
MKKVIVITGASDGLGKTLTESLSKENNVIALATTEEKLQKVAEDNNCNYKVCDVRDYHQVEKCTNEIIEEFGKIDILINNAGLWIQEELEENDVERIHDVIDVNLLGMIYMTKTVIPIMKSRQDGIIININSQAGINHKAERVVYNASKWGVTGFSKSLQDEVAKYGIRVTDILPGMLKTDMFNKMNIKKNMENGLDTKEVARLVKFIIDTPKDVMIPEVGIKNINN

SEQ ID NO: 1685 - protein, 266 aa, Artificial Sequence
  Synthetic
MKNLERFGKLFDLTGHVAVVTGAAQGNGMGIANALYDAGATVVATDIAFGEKKENPRENLYDGIDRMIMDVTDEANVEQVFAAIAEKYGKLDILANNAGIIYKNPVDKLEMDRFKKVIDINLNGVTICTKHAVPYMKKVGWGRIVNVSSSQAFLTSETYSAYSASKAAVSHLTRIWGNELADYNILVNAICPCYVMTPMMVGSIARKAAELGTGTDGGYKYFADLVPTHRLLEVEEVGNWAAVLCSELGLATTGSNISITCGQVQL

SEQ ID NO: 1686 - protein, 252 aa, Artificial Sequence
  Synthetic
MSKTVLITGATSGIGHATALAFAKAGYDLLVCARRLEVLENMKAEFEPEYGIKVTPFALDVTDRKAVSEILPAVIEKAGGVDILVNNAGLAQGLDPFQESSIDDIELMINTNVKGLLYVSRTVLPFMLAKNAGHIINLGSTAGIYAYAKGAVYCATKAAVKTLSDGIRIDTIESDIKVTTIQPGIVETPFSEVRFHGDKEKAAAVYAGVEALQAEDIAEIIVFAATQPKRVQISDITIMANQQATGFMIAKK

SEQ ID NO: 1687 - protein, 227 aa, Artificial Sequence
  Synthetic
MLEGKIALVTGASRGIGRQIAKTLAAKGAAVIVNYNGSAAKAEETVREIREAGGSAEAIQCNVSDFNSSKEMLDGIVAKYGRLDILVNNAGITRDNLVMKMSEEDFDAVIQTNLKGVFNCIHHISRQMLKQRAGRIINISSVSGVLGNAGQANYCAAKAGVIGLTKSVARELASRGITVNAVAPGFIRTDMTDVLKDEVKKAMMEQIPMKDFGEVEDIANAVAFLAS

SEQ ID NO: 1688 - protein, 225 aa, Artificial Sequence
  Synthetic
MKTVLITGATDGIGKAIAQLLDEKGYELYLFGRSQVKMDALNINHCKGKYTFDLKDRTALQQTLDDIVQQGGVDVLINNAGFNAKKAAVKDIAIEDLEDMYSVNTIAPLICIQKCIPAMLEKKDGMIINILSSCCLFSNPDNGGYTSSKDAFEALSKILVKEVKGAGVKVLDVYPGGVDTNFRTNDRPDYLKPETVAKHVIYALENNEDGMLQEIVVRPVVESNY

SEQ ID NO: 1689 - protein, 266 aa, Artificial Sequence
  Synthetic
MDMKNLFSLEGKVALVTGAAYGIGFAIAEAYAKAGAKIAFNCRSTEHMEKAMAAYRGKGIDAKGYICDVTDEAQVEKMVADIEKELGSVDILVNNAGIIKRIPMTEMKAEEFRQVVDIDLNAPFIVSKAVLPGMMKKKHGKIINICSMMSELGRETVSAYAAAKGGLKMLTKNIASEYGAYNIQCNGIGPGYIATPQTAPLRETQPDGSRHPFDQFIIAKTPQARWGTPEDLMGPAIFLASDASDFVNGHILYVDGGILAYIGKQP

SEQ ID NO: 1690 - protein, 252 aa, Artificial Sequence
  Synthetic
MGKLDNKVAIITGGNAGVGKEIAKLFASEGAKVVISARRQQILEEAAKEIEAAGGTVLCVPTDISKVDDVKNLVNKTVETFGQLDILINNAGVLDKGLNAIDQIDYDDLNRVIDINQKGTMYCMSEALKVMKSGASIVNISSVAGQYGAGGAVYVSTKAAIIGVTKHAAMRFAKEKIRCNVICPGSITTDMAAGLTPDTMDMKMMGAMSAHSDLSLQPCSPLDVAKVALFLASDDAAPLTGQVVVSDYGVDL

SEQ ID NO: 1691 - protein, 246 aa, Artificial Sequence
  Synthetic
MKRKYAVVTGGSRGIGAEIVRALCRSGCDVIVNYKSSAESAKVLCREINALGAGRAIPFCADVSDESGARRLIAKAMMEFGRLDILVNNAGVASPQALIDITEDELRRVMGTNFDGTLFCTRAAAREMIGAGCGGAIVNVSSMWGICGAAGEAVYSASKAAVINLTKSLAKELATADIVVNCVAPGVINTEMNSCYDEETMKELKKRTPLGRLGEPADVARAVTFLSLENTFITGQTLCVDGGFIL

SEQ ID NO: 1692 - protein, 225 aa, Artificial Sequence
  Synthetic
MKTAIVTGASSGIGKAIAEVLVKNGYEVYGIGRNFTEDVRFHAIVCDLLDEKQYQAMMLSLPKEIDVLVNNAGCAYYGMHETMSDARIHEMIKLNLEIPERMSQHYIRALRLRQGMMINVASITGTHPSPHAACYASTKAAMISFSNSIFEENRKHGVKVTCLIPDMTETNLYRNADFKADENDGCCLYPMDIANVVEQILSQRNGIVAKEIIIQPQFHRIQKKK

SEQ ID NO: 1693 - protein, 266 aa, Artificial Sequence
  Synthetic
MDLSAFNLQGKVALITGGAHGIGFSIAEGMAKCGAAICFNCSSEASLEKGLAAYKAAGIDAHGYVADVSDEDAVNAMVAKIKAEVGPVDILVNNAGLMKRVPMVEMSHADFMRVIDVHVGGAFNCSKAVLPDMMEKHEGKIINICSMMSELGRETVSAYAAAKGALKMLTKNIASEYGEYNIQCNGMGPGYIATAQTAPLREVQPDGSRHPFDQFITAKTPAGRWGEPDDMVGPCVFLASHASDFVNGQILYADGGILAYIGRQPK

SEQ ID NO: 1694 - protein, 252 aa, Artificial Sequence
  Synthetic
MKLENKVAIVTGAGSGMGKAIAELFAKEGAKVIASDINETGVKELIASSGDIAGEIVFSQTDVSNRSQVEAMIDLAVNKYGKLDVLVNNAGVLDKMYSVTEVEDEFWDKVMSINVNSVMYACRKAIPIMMKNGGGSIINTASVGGLFGCRAGAAYTASKFAVVGLTKNIGFMYAKEGIRCNAICPGSIITNIAAGLSNASEFGMARSGAGVPLSPRMGQPEEIANTALFLASDEASFINGTTVTVDGGWTAY

SEQ ID NO: 1695 - protein, 246 aa, Artificial Sequence
  Synthetic
MLEGKIALVTGASRGIGRQIAKTLAAKGAFVIVNYNGSAAKAEEVVKEIQAAGGNGQAVQCNVSDFESCKEMLDAVVKEHGHLDILVNNAGITRDNLLMKMSEEDFDAVIQTNLKGVFNCTRHIARQMLKQKSGRIINISSVSGVLGNAGQANYCAAKAGVIGLTKSAAKELASRGITVNAVAPGFIKTEMTEVLKDEIKNSILEHIPMKAFGETEDIANAVAFLASEEARYITGQVISVDGGMAM

SEQ ID NO: 1696 - protein, 224 aa, Artificial Sequence
  Synthetic
MKTVLLTGANKGIGLEVVNKLLAKGFYVIALSKSVDNLEQITHPNLKIYMVDLLNITELLRIVDEIKNENICIDILINNAGVGLFKKIEDYTIEEWNEVMHINLTVPFILIKKVLPEMKKRKYGRIINIGSDADSIPFPEAGVYCASKYGLRGMTESMRLDLKKTNINITTISPGRVDTYFNGKYPGCRPDALQVSDIANQILFVLEQDDRCNIEQIKLTSAFE

SEQ ID NO: 1697 - protein, 266 aa, Artificial Sequence
  Synthetic
MDLSAFNLQGKVALITGGAHGIGFSIAEGMAKCGAAICFNCSSEASLEKGLAAYKAAGIDAHGYVADVSDEDAVNAMVAKIKAEVGPVDILVNNAGLMKRVPMIEMSHADFMRVIDVHVGGAFNCSKAVLPDMMEKREGKIINICSMMSELGRETVSAYAAAKGALKMLTKNIASEYGEYNIQCNGMGPGYIATAQTAPLRERQPDGSRHPFDSFIVAKTPAGRWGDPEDMVGPCVFLASHASDFVNGQILYADGGILAYIGRQPK

SEQ ID NO: 1698 - protein, 252 aa, Artificial Sequence
  Synthetic
MRFTGKVVIITGSGAGIGQAAAVAFAREGAKVVVNSVTEKSGAETLALVEKQGGEGIYVQGDVSKSEDVKKIVAATIGRFGTVDVLVNVAGIVIAGRADNTREEDWDKMMDVNAKGTFMMIREVLPCMLEKHHGSIVNIASIAAQKGLKDRFAYSASKGAVLSMSHSLAAEYVDQGIRCNVVCPGTILTPSLQYRIDHAENPEAMKADFFARQPIGRLGKPEEVAEAILFAADDAAGFMTSAVVSINGGMII

SEQ ID NO: 1699 - protein, 246 aa, Artificial Sequence
  Synthetic
MLAGKIAVVTGASRGIGRAIALRFAKEGAHVIVNYNGSEDRAESVKEEIEKAGGSAKISKCDVSDFEKCESWIQSIIEEYGKIDILVNNAGITKDGLLMKMSESDFDQVIATNLKGTFHTIRFVSRQMLKQRSGRIINLSSVVGVAGNAGQANYAASKAGVIGLTKSAAKELASRGITVNAIAPGFIDTEMTAVLPDKVKEATKSQIPMRQYGTPEQVASAAAFLASEEAGYITGQVLHVDGGMVM

SEQ ID NO: 1700 - protein, 224 aa, Artificial Sequence
  Synthetic
LELAKHGAKLVLAARRVARLQKLVEKIKAAGSEAIAVATDVSKNIDVVALADAAKAKFGRIDVLVNNAGVMLMAPMAKCKVDEWERMIDINVKGVLYGIAAVLPTMQAQKSGQIINISSVAGLKVSSGIGTVYSATKFAVKTISEGLRAESKGDVRVCTIYPGAIATELAQHSSDEAAKAGIQAFYAANEITPDAVARAIVFAVSQPADVDINDITIRPSRQEF

SEQ ID NO: 1701 - protein, 266 aa, Artificial Sequence
  Synthetic
MDLSAFNLQGKVALITGGAHGIGFSIAEGMAKCGAAICFNCSSEASLEKGLAAYKAAGIEAHGYVADVSDEDAVNAMVAKIKAEVGPVDILVNNAGLMKRVPMIEMSHADFMRVIDVHVGGAFNCSKAVLPDMMEKRAGKIINICSMMSELGRETVSAYAAAKGALKMLTKNIASEYGEYNIQCNGMGPGYIATAQTAPLRERQPDGSRHPFDSFIVAKTPAGRWGDPEDMVGPCVFLASHASDFVNGQILYADGGILAYIGRQPK

SEQ ID NO: 1702 - protein, 252 aa, Artificial Sequence
  Synthetic
MKALITGASSGIGRDMARILSKKGYELVLVARDNDKLKEVKEELEKETKVEIISVDLTNEENCKEIHNKVQNVDLLINNAGFGDCGDFTKTSLEKDINMIKTNIIAYHILTKLYLKDMKEKNKGKILNVASIAGFMPGPLMATYYATKSYVVRLSESIREELRKEKSNVKISILCPGPVETNFNKVANVKFHLREANSMDVAKYAINKVEKGKFYIVPGIDIKLAKIGAKLTPANLVSKITYKVQKRKITNK

SEQ ID NO: 1703 - protein, 246 aa, Artificial Sequence
  Synthetic
MLQGKIAVITGASRGIGKAIAERFASEGAFVIINYNGSKEHAQEVKREILEHRGNAEIMQCNVADFAACETFIKQIVDKYGRIDVLVNNAGITKDGLLMRMSEEAFDDVIATNLKGAFHCIRFASRYMMKQRQGRIINMSSVVGVAGNVGQANYAASKAGLIGLTKSAAKELASRNITVNAIAPGFIQTEMTEILSDAVKEETKAKIPLGTFGSPKDVANAAAFLASEEAGYITGQVLHVDGGMVI

SEQ ID NO: 1704 - protein, 223 aa, Artificial Sequence
  Synthetic
LLEALARELQDTYGTTVYIISKDLSKETAPEEIYAEVQAKGLQVDYLINNAGLGGQGAFAERSMEIDMNLIAVNIISLTKMTKLFLPDFLKRKSGRILNVSSTAALMPGPLQAVYYASKAYVTSLSNAIWQEIQGSGVTMTLLMPGGMDTGFAAASGLQNTSLAKQMVFSPREIAEPTYAAMLRGQMELIEKLNFIQKLSFKLLPFLPKKLIMKQIYNMQQST

SEQ ID NO: 1705 - protein, 266 aa, Artificial Sequence
  Synthetic
MSEKMFSLEGKVALVTGAAYGIGYAMAKALAKAGAKIAFNCRGEKHMEEALKAYKEDGIEVKGYFCDVTKEDQVKEMVADIEKTMGTIDILVNNAGIIKRIPMTDMSTEEFKEVIDIDLIAPFVVSKAVVPGMIKKGHGKIINVCSMMSELGRETVSAYAAAKGGLKMLTKNIASEYGEYNIQCNGIGPGYIATPQTAPLRELQADGSRHPFDQFIISKTPAARWGTPEDLEGPAVFLASEASDFVNGHILYVDGGILAYIGKQPK

SEQ ID NO: 1706 - protein, 252 aa, Artificial Sequence
  Synthetic
MMEKKVVIITGGSAGIGYAAAKLFLEKDCRVVILSTNEEKGLRAQERLSEFGEVTWKHCCVQDYEECRKVVDETMDTYGRIDVLVNNAGVVSRRESFFKADMEDIRRTMDINVMGTIHMIHAVSKYMADQQKGTIVNIGSICGTMANSESVGYHASKGAVEMVTKSLARELSGYGIRVVCVSPGWVRTEMIDDAVAKIGASLHMKGRIVEPEEIAGVVYLMTLDEASAVNGTTVMADDGYSAFKGIDGGQRL

SEQ ID NO: 1707 - protein, 246 aa, Artificial Sequence
  Synthetic
MLTGKIAVVTGASRGIGKEIAKTLAAKGATVVVNYNGSAAKAEETVKEIEALGGKAEALQCNVSEYDKAAEMMEYVVKTYGRVDILVNNAGITRDNLLMKMSEEDFDAVLNTNLKGAFNCIKHISRQMLKQKSGHIVNISSVSGVMGNAGQVNYSASKAGVIGMTKAVAREMASRGITCNAVAPGFIKTDMTDVLSDTIKENINAQIPMKKFGETEDVANLVAFLASDAAKYITGQVICVDGGMAM

SEQ ID NO: 1708 - protein, 222 aa, Artificial Sequence
  Synthetic
MKTVLITGGATGIGRAAAELFLQNGYEVFVTVHETPCTLAGVQSVPCDLRDLSQIEALFSQFARLDVLVNNAGVSLIQQINDTTLADYEQVMQVNARAAFFCAKQAALRMLKRHSGSIINVSSVWGQLGASCEVAYSMSKAAVIGLTKALAQELAPSGITVNCVAPGIIDTRMNAPFDAQDLAQEVPCGRLGTPQEAAQAIYALTQNPYITGQVLGVNGGMV

SEQ ID NO: 1709 - protein, 265 aa, Artificial Sequence
  Synthetic
MSVNFSLEGKIALVTGASYGIGFAIASAYAKAGATICFNDIKQELVDKGLAAYKELGIEAHGYVCDVTNEEQVNALVAQIEKEVGVIDILVNNAGIIKRIPMCDMTAAEFRQVIDVDLNAPFIVSKAVIPSMIKKGHGKIINICSMMSELGRETVSAYAAAKGGLKMLTKNICSEYGRYNIQCNGIGPGYIETPQTAPLRERQADGSRHPFDSFIIAKTPAERWLKPEELAGPAVFLASDASDAVNGHILYVDGGILAYIGKQPQ

SEQ ID NO: 1710 - protein, 252 aa, Artificial Sequence
  Synthetic
MKALVTGASSGIGREIARYLASMGYDLIVVARSTDKLNALKEELSNVNVRVITLDLAREQDALDLYEHTKNEDIDFLVNNAGFGVYGKFLEVPLEQELNLIHTNVSSLHILTKLYLQDMVKKNRGYILNVGSSAGFLAGPTFSSYYASKNYVVRLTEAIHEELRRDNINVKVSALCPGPVDTSFNDVADVKFSMKGLNAKDVAKYAVDNTLKGKMIIIPGFMMKVTKFAQHFVSENMLTRLSYNVQSRKSGK

SEQ ID NO: 1711 - protein, 246 aa, Artificial Sequence
  Synthetic
MLTGKTAVVTGASRGIGRAIALRFAREGAHVIVNYNGSKDRAESVKEEIEKAGGSAQISQCDVSDFAMCESWIQSIIAEHGKIDILVNNAGITKDGLLMKMSESDFDQVIATNLKGTFHTIRFVSRQMLKQRSGRIINLSSVVGVAGNAGQANYAASKAGVIGLTKSAAKELAPRGITVNAIAPGFIDTEMTQVLSDKVKESTRNQIPMGQYGTPEQIASAALFLASEEAGYITGQVLHVDGGMVM

SEQ ID NO: 1712 - protein, 222 aa, Artificial Sequence
  Synthetic
MLASGGADVALLDLNAEKLCGAEKEARQYAGRTVALPCDISREAEVYAAVSKAEAALGHIDILVNNAAVWRCWDAFVNVSAEEWRKFIDVNLMGTVYCTRAVLPGMLERRYGKIVNVASVAGVYGNANMAHYSATKGAVISLTYALAKEVAEKGICVNCVSPGSVSPAENPDMDYFQESGLSYLGRTGTDNENANLICFLASDEASYISGQNIQIDGCRRKL

SEQ ID NO: 1713 - protein, 265 aa, Artificial Sequence
  Synthetic
MRLKGKVVLITASTRGIGLACAVRCAKEGAVVYMAARNMERAEARAKELNEQGYTVKTVFNDASDKDSYRTMVEEVIRQEGRIDVLVNNFGTSNPKKDLDIKSTEYEEFIGTLDMNLASVFLPVQAVIPHMAKQGGGSIINISSIGGLRPDISQIAYGTSKAAINYMTKLIAVQAARDNIRCNAVLPGMTATDAVKDNLSDDFREFFLKHTPIRRMGEPEEIAAAVVYFASDDAAYTTGQIMDVSGGFGMPTPVYGDMIERTDRR

SEQ ID NO: 1714 - protein, 252 aa, Artificial Sequence
  Synthetic
MNRKIFVTGATSGIGLECARAFAKDGDNLLLAGRRADRLAAIKEDFEQQYGVRVDTLVLDVSKREDVESKVKPAIEAFGGIDVLVNNAGLAQGLDDFQDSSVDDAVTMINTNVIGLIYVTKAVLPFMLAQNSGHIVNMGSTAGIYAYPKGAVYCATKAAVKTLSDGIRMDTIATDIKVTTIQPGIVETPFSEVRFHGDAERAASVYAGIEAVQPEDVADVVLYVTNQPKRMQISDVTIMANQQAAGFMVHKK

SEQ ID NO: 1715 - protein, 246 aa, Artificial Sequence
  Synthetic
MTDKKVAVVTGASRGIGRAVAIELGKTGAFVVVNYNGSEDKANEVKKEIEALGGEACTWQCDVSDFAAGETFFKEIIKQYGRIDILVNNAGITRDGLLMGMSEEDFSRVIDVNLKGCFYGIRHVARQMIRQRSGRIINLASVVGVRGNAGQANYAASKAGVIGLTKSAAKELASRGITVNAIAPGFIKTDMTDALSEKVKSGIREEIPMKEFGNPEDVAKAVSFLASEGAGYITGQVLCVDGGMAM

SEQ ID NO: 1716 - protein, 222 aa, Artificial Sequence
  Synthetic
MKRKALITGASKGIGEAIATQLMSEGYSVVTPTHEELDLSSDSSIEHFVEKYRNEHFDVIINNAGINEIHEIDQITDDEIERTIQINLIAPMKLLRNFVSSMKAQHYGKIVNIGSIWGIVSKPGRVIYSASKHGIHGVTKTLAVELAEYNILVNTVCPGFTLTELTRKNNTEEQIVQIGEAIPMKRMAEPKEIADAVCYLVSERNTYITGQLIAVDGGYTSI

SEQ ID NO: 1717 - protein, 265 aa, Artificial Sequence
  Synthetic
MSSETKIWRLTDRNTEGNMNLTGKVTLVTGASRGIGRQIALTLAGYGATVIVNYNGSAAKAEEVVNEITANGGMAESMQCSVSDFEKSKEMIDGIVKKYGRLDILVNNAGITKDNLIMKMSEDDFDAVIATNLKGAFNCIKHVSRQMLKQRGGRIINISSVSGVMGNAGQANYCASKAGIIGLTKSVARELGSRGITSNAVAPGFIRTEMTDVLPEDVKKAMGEQIPLKHFGETKDIAEAVAFLASDEAAYVTGQVLHVDGGMAM

SEQ ID NO: 1718 - protein, 252 aa, Artificial Sequence
  Synthetic
MATNKLNLEGKSVLVTGGSRGIGRAIAIAFAENGADVAINYTSNEEAALEVSKEIEALGKTCKIIKCDVSDFENATKMVEDVVAEFGKIDILVNNAGITKDGLLMRMKEEDFDKVIDINLKGVFNVTKAATKFMMKKKYGRVINMSSVVGVVGNAGQANYCASKAGVIGFTKAVAKELASRNINVNAIAPGFIETDMTDVLSDDVKGKMLEQIPKKCIGNAENIADTALFLASDMSSYITGQVINVDGGMVM

SEQ ID NO: 1719 - protein, 246 aa, Artificial Sequence
  Synthetic
MLNEKIAVITGASRGIGAAIAKKMAENGATVIINYQGSVQAAQALEAEIIEKGGKAVTYKCDVSDFDKCEKFIGDIVKEYGRIDILVNNAGITRDGLLMGMKEEDFDSVINVNLKGTFNTIRFASRTMVKQRKGKIINISSVSGVTGNAGQANYSASKAGIIGLTKSAARELASRNINVNAIAPGFVDTDMTITLSDKVKEGAKGQIPLGRFGKPEEVAELALFLSSEKSDYITGQVINIDGGMVM

SEQ ID NO: 1720 - protein, 199 aa, Artificial Sequence
  Synthetic
MRVLITGTSSGIGKGIAEKFLKEGHNVTGIDRKDASIQHKNYTHICMDIRAKEQYPELEPFDIVINNAGVQNEEDIDVNLKGTIGITEKYGIRPGIRSVLMIGSASGHNGSEFPEYVASKGGVLSYTKNVALRIAKYGAVCNSLDFGGVLTELNKPVMEDKALWDEIMEQTPLKRWMTVEETADWAYFMTVTNRFCTGQ

SEQ ID NO: 1721 - protein, 265 aa, Artificial Sequence
  Synthetic
MMSQFSLEGKVALVTGAAYGIGLAIAEAFAKAGAKIVFNCSRQETVDRGLKAYKEKGIEAKGYLCDVTNEESVKAMVADIEATVGTIDILVNNAGIIKRIPMEEMAVEDFRRVVDVDLIAPFIMSKAVIPGMIKKGHGKIINICSMMSELGRETVSAYAAAKGGLKMLTRNICSEYGEANIQCNGIGPGYIATEQTAPLRERQADGSRHPFDQFIISKTPAGRWGTPEDLMGPAVFLASDASNFVNGHVLYVDGGILAYIGKQPK

SEQ ID NO: 1722 - protein, 252 aa, Artificial Sequence
  Synthetic
MLDFTDQVIIVTGAGSPKGIGRVIAKTFAKQGGTVIIADINQSGVDETVQTIQDEGGKAEGILLDVTSKESVENMVAQVMQKYGRIDVLINNAGISQKVTVAEMTLDDMKRIFNVNMFGLFLCTQACMKPMIEAGYGRIVNLSSVSAKRGGGIFGGAHYSASKAGVLAFSKNLSREICKYGITINCVCPGLINTEIWKSLPQEQAQKIIDGIPVGRPGETQEVADTIVFLASKEASYITGEEIDINGGQHMD

SEQ ID NO: 1723 - protein, 246 aa, Artificial Sequence
  Synthetic
MLEGKVAVVTGASRGIGKAIACKLASMGATVIINYNGSKDKAEEVKAEIEGAQGKAAVYQCNISDYGKCESFIQEVIKTYGSIDILVNNAGITRDGLLMKMSEEDFDQVIDTNLKGAFNTIRFASRQMLRQRSGRIINMSSVVGVSGNAGQANYAASKAGVIGLTKAAARELASRGITVNAIAPGFIDTDMTEVLPDKVKEACVSQIPLGTFGKPEQVAQAVAFLASEDASYITGQVLHVDGGMAM

SEQ ID NO: 1724 - protein, 220 aa, Artificial Sequence
  Synthetic
MRVLITGTSSGIGKGIAEKFLKEGHSVTGIDRKEAAVYHENYRHICMDIRAKEQYPDFPPFDIVINNAGVQNEEDIDVNLKGTIGITEKYGIHSGIRAVLMIGSASGHNGSEFPEYVASKGGVLSYTKNVALRIAKYGAVCNSLDFGGVLTELNKPVMEDKALWEEIMEQTPLKRWMTVEESADWAYFMTVTNRFCTGQNILIDGLEAGNAHFVWPETEN

SEQ ID NO: 1725 - protein, 265 aa, Artificial Sequence
  Synthetic
MSVNFSLEGKIAFVTGASYGIGFAIASGMAKAGAKIVFNDIKQELVDKGLAAYKEAGIDAHGYVCDVTNEEAVNATVEKITKEVGPIDILVNNAGIIKRIPMCEMTAAEFRQVIDVDLNAPFIVSKAVIPSMIERGHGKIINICSMMSELGRETVSAYAAAKGGLKMLTRNICSEYGKYNIQCNGIGPGYIETPQTAPLRERQADGSRHPFDQFICAKTPANRWLKPEELAGPAVFLASEASDAVNGHILYVDGGILAYIGKQPQ

SEQ ID NO: 1726 - protein, 252 aa, Artificial Sequence
  Synthetic
MFAFITGATSGIGLATAKALAGKGYDLAIAARNENKLKEIKEEIEKDCSVKVTYYVLDVSNSDDIRKITARCMEELGVPDILVNNAGLARGLEPYYESEEADVVEMIETNIKGLFLMTRAFLPAMVKRNTGHIVNLGSTAGLYAYAGAAVYCATKAAVKTFSDGIRIDVIDSDIKVTTIQPGIVETPFSEARFKGDKKRAAAVYEGIDALQAEDIADIIAFAIDRPKRVQISDIVIMANQQATGFTVSKKKK

SEQ ID NO: 1727 - protein, 246 aa, Artificial Sequence
  Synthetic
MSKLLGKVAIITGASRGIGRAIAIELGKEGASVVINYSKDEEGAKETLEALRELGGVAYAVKRDVSSFEGAEEIINKTLEHFGKVDIVVNNAARSTLGLFMDATREDIEGLISTNLLGAMYLTKLAIPHMLGKGGAVLNISSMWGEVGASCEVLYSTSKGGLNLFTKALAKEMAPSNVRVNAIAPGVIDTKMNSFLSQEEREELENEIPVGRFGLPEEIGKTAVFLCSDDSSYITGQILRVDGGYI

SEQ ID NO: 1728 - protein, 219 aa, Artificial Sequence
  Synthetic
MKVLITGTSSGIGKGIADKFLREGHHVTGIDCNKSAIQHTAYRHICMDIRDKMHYPELGPFDIVINNAGVQNNNDIDVNLKGTIDITEKYGIHPGIRAVLMIGSASGHNGSEFPEYVASKGGVLSYTKNIALRIAKYGATCNSLDFGGVLTELNKPVMEDKVLWNEIMEQTPLKRWMTVEEAADWAYFMTVTNRFCTGQNILIDGLEAGNAHFVWPEEQ

SEQ ID NO: 1729 - protein, 265 aa, Artificial Sequence
  Synthetic
MSVNFSLEGKTALVTGASYGIGFAIASGMAKAGATIVFNDIKQELVDKGIAAYKEAGIEAHGYVCDVTNEDAVNEMVAKIAKEVAPIDILVNNAGIIKRIPMCDMTAAEFRQVIDVDLNAPFIVSKAVIPSMIERGHGKIINICSMMSELGRETVSAYAAAKGGLKMLTRNICSEYGQYNIQCNGIGPGYIETPQTAPLRERQPDGSRHPFDQFICAKTPANRWLKPEELAGPAVFLASEASDAVNGHILYVDGGILAYIGKQPQ

SEQ ID NO: 1730 - protein, 252 aa, Artificial Sequence
  Synthetic
MLKGKVAIITGASYGMGRTMAELFAEEGAALVITARHQEKLDEVVDGIRAKGGKAVGVVADVCATEDTQRVFETALKEFGDVDILINNAGIGEQKMIDETDDEWMMYVMNTNLGGPMRYIREALKIFLPKNDGVIINISSVNGTRPFCGATYTATKGALNTLTRNVAMRLIDTNIRCNAVAPGATITPAHLTNKAGEQPGGAEMLKYSGHFVYFPGPECDPMDQAYACLYLASKMGRAVRGQVIQVCNGAFL

SEQ ID NO: 1731 - protein, 246 aa, Artificial Sequence
  Synthetic
MDIKGKVALITGGGTGVGKGVALRLAKEGTNICINYAHSEKEAYEAKAEVEALGVKCGVYKADVSDDAQCRNMIAEVLKDFGQLDILVNNAGRTHFVDHSDLEGMKGEYFDDIFNLNVKGTFFMCRAAADALRKSHGVIINITSIAGVTGLGSSIAYAASKAAEISITKSLARVLAPEVRVIGVAPGIVLTRWVEGRTGHIDKLAGDTPLQKVAVPEDIAQTVYALIAHADFVTGQNLIVDGGAFI

SEQ ID NO: 1732 - protein, 219 aa, Artificial Sequence
  Synthetic
VITYNGNSAKADEVKQRLEKDYSVHVEPYKLAVQSEEEVAAFRRWAEENMGENLCVLVNNAGIYCNVPAEEIDPAQFRDLMEVNVNGTFYMCRYFVDLMIKRHFGKIINLCSAVGLRAAPGSIAYAASKFAVRGMTQAMAIDLGKYNIQVNAIAPGAHKTDMYNASYKQNPELMDTRTKQCPLQRAGELTEMHHLVRYFMSSDFITGQVVSPNGGTTMI

SEQ ID NO: 1733 - protein, 265 aa, Artificial Sequence
  Synthetic
MKGLELFNLSGKVALVTGSSHGLGMAVATALAQAGATLVINGASSAEKLAEAVKEYAKQGIHAHAYLFDVTNEQQVTEYVSKIEREVGPIDILVNNAGIIKRIPALEMSLTDWQQVICTDLTGPFLMSKIVAKGMKERGGGKIINMCSMMSEVGRDTVSAYAAAKGGLKMLTKNLATEWARYHIQVNGIGPGYFATSQTAPIRVNGHPFHEFILKRTPAGRWGNPEDLAGTAIFLASPASDFVTGQVVYVDGGILASLGKAANED

SEQ ID NO: 1734 - protein, 252 aa, Artificial Sequence
  Synthetic
MGRFLENKVCIITGAAQGIGKSIAERFAGDGAIVYACDRQEGSMDVWVKQCAAVQDTRVIPLYFDVTDAAAVKSAFMSIFKREGRIDVLVNNAGVVFNKKIGMIVRPETEQMFRVNVIAVIEMVQLVSRLMARNGGGSIVNIASVTAVLGSPGQSAYSATKGAIMAFTKSAAKELAPLGIRVNAVAPGIVKTERFSELYEESGEKIDTRIRKIALGRLGTPEDVANACAFLASDRASYISGQILGVDGCASI

SEQ ID NO: 1735 - protein, 246 aa, Artificial Sequence
  Synthetic
VFEGKVALVTGAGKGIGKEIALELARGGAKCVINYASSAAGAESVAEEIRAMGSEAMTYKCDVSDADAVQKMITDVMEQYGRIDILVNNAGITKDGLMLKMTEADFMTVLDINLKGAFNCMKAVTKPMMKQRYGRIINITSIVGIIGNAGQVNYAASKAGLIGMTKSAARELASRNITVNAVAPGFIETDMTDVLPDSVKEQLLAQIPMKKLGQTGDIANAVCFLADEKASYITGQVLQVNGGMAM

SEQ ID NO: 1736 - protein, 219 aa, Artificial Sequence
  Synthetic
LAPHCNVAFTYLSSEDAARALEEELKEYGGVKAFRCDVSDPNAVRETADAVRARFGSVDKVVNCAGISVRGLLQDVTDAEWRRVFAVNCDGTFYVTRAFLPDMISKKRGSIVNVASVWGVTGGAAEAAYSASKAAVIGLTRALAKEVAPSGITVNAVAPGAVDTDMMKCYSQAELAALAEEIPLGRLASPDEIASAVVFLLGHGYITGQVLTADGGFIG

SEQ ID NO: 1737 - protein, 265 aa, Artificial Sequence
  Synthetic
MEDLFNLKKKIIVITGGNGHLGKGMCEALAKYGATLIIASSNFEKNKLLCEELNKKYKNENIPLSLDLSAKEEINKVFQEIIKKYSQIDVLINNSYYGAGGKFHDMSFENWEKGLDGSINTTYNCTRAVIENMRKNKKGKIINIASMYGVIAPNVYELYDGDNCEKYYNPINYGVGKAGIIQFTKYIAAVYGKEGITCNCISPGTFPSEKVQENKIFIERLTNKVPLKRIGKPEDLQGAIVFLCSDSSDYINGHNMVIDGGWTIW

SEQ ID NO: 1738 - protein, 252 aa, Artificial Sequence
  Synthetic
MRGARIAVITGASSGLGRAFALETGRLGGIDEIWLIARRRDNLERLAGELPVKGRALSLDLLAEDSFASLKKLLEEERPAIALLVNNAGRGSAVSFEEESLKDMGDMVRLDAEVPVKLTGLCLPYMKGSAGIINVCSAASLVPLPGLSVYSASKSFLLSFSRSLHRELKGRGIAVTALCPYWIGDTEFMEKAGASVHPLGLLTAKEVARQGLSDNRRGREMSLPGIMSRLTWLGAALLPLPVLLFFKRLFGA

SEQ ID NO: 1739 - protein, 246 aa, Artificial Sequence
  Synthetic
MDKKVALITGGSRGIGKKIAEKFARNGYNIVINYVSEKTDVNKLESDLSQNGKVEVLCIKCDVTDFNSCQEMVKEAVDKFGKIDVLINNAGITKDNLLMRMKEEDFDKVINVNLKGTFNMTKNVISYMMKKRSGRIVNISSVVGVSGNSGQANYAASKAGIIGFTKSVAKELASRNILANAVAPGFIETDMTDVLSESVKESIYSQIPLKKMGKPEEVANAVYFLGSDENTYITGQVLNVDGGMIM

SEQ ID NO: 1740 - protein, 218 aa, Artificial Sequence
  Synthetic
MRVLITGTSSGIGKAIAEKFLKEGFDVTGFDRKEASIRQESYTHFCLDIRAREQYPALAPFDIVINNAGVQNEDDIDINLKGTIAITEAYGIHDNIRAVLMIGSASGHTGAEFPEYTASKGGVLAYTKNVALRIAPYGGTCNSLDFGGVLTELNLPVTEDKKLWDQIMDLTPLKRWMTVEEAADWAYFMTVTNRFCTGQNILIDGLEAGNAHFVWPDE

SEQ ID NO: 1741 - protein, 265 aa, Artificial Sequence
  Synthetic
MSVNFSLEGKVALVTGASYGIGFAIASGMAKAGATIVFNDIKQELVDKGLAAYKEAGIDAHGYVCDVTNEEKVNAMVAQIAKDVAPIDILVNNAGIIKRIPMCDMTAAEFRQVIDVDLNAPFIVSKAVIPSMIERGHGKIINICSMMSELGRETVSAYAAAKGGLKMLTRNICSEYGQYNIQCNGIGPGYIETPQTAPLRERQPDGSRHPFDSFIVAKTPAERWLKPEELAGPAVFLASEASDAVNGHILYVDGGILAYIGKQPQ

SEQ ID NO: 1742 - protein, 252 aa, Artificial Sequence
  Synthetic
MNRKIFVTGATSGIGLECARAFAQDGDNVLIAGRRPDRLAAIKEDFEQQYGIRVDTLVLDVSKREDVDAKVKAAIEAFGGIDVLVNNAGLAQGLDPFQDSSVDDAVTMINTNVLGLLYVTKAVLPFMMAQNSGHIVNMGSTAGIYAYPGGAVYCATKAAVKMLADGIRMDTIATDIKVTTIQPGIVETPFSEVRFHGDAERAASVYAGIEAVQPEDVADVVLYVTNQPKRMQISDVTIMANQQAAGFMVHKK

SEQ ID NO: 1743 - protein, 246 aa, Artificial Sequence
  Synthetic
LLSPNQNLQGKRILVTGASSGIGNAIAVACANAGAIVISTGRNRDALDSLTTSLDGDGHSYIVADLTDTAERDRLVQAIPPVDGVVHAAGIGQTLPAKFTTEQDVDKVFDINFKAPVMLQTQLITNKKIAKGASIVFIASITATKPMVGNSLYSASKAALVSYARVLALELAPRKIRVNCISPAMVWTKLLSTGGISLEQLKADEQTYPLKRYGQPEDIAPLSVYLLSEASSWMTGSNIDITGGIH

SEQ ID NO: 1744 - protein, 218 aa, Artificial Sequence
  Synthetic
MVNFSLEGKVALVTGASYGIGFAIATGFAQAGAKIVFNDIKQELVDKGLAAYKELGIDARGYVCDVTNEEAVNALVAQIEKEVGVIDILVNNAGIIKRIPMCEMSAAEFRQVIDVDLNAPFIVSKAVIPSMIKKGHGKIINIRCIEKDRYGIIYSGHFFEIDFFKGDNEGLCLAEVELFREGEEIELPDFIIKEVTDDPKYYNKNLYINPYKNWNNNG

SEQ ID NO: 1745 - protein, 265 aa, Artificial Sequence
  Synthetic
MSVNFSLEGKIAFVTGASYGIGFAIASGMAKAGAKIVFNDIKQELVDKGLAAYKEAGIDAHGYVCDVTNEEAVNATVEKITKEVGPIDILVNNAGIIKRIPMCEMTAAEFRQVIDVDLNAPFIVSKAVIPSMIERGHGKIINICSMMSELGRETVSAYAAAKGGLKMLTRNICSEYGEYNIQCNGLGPGYIATPQTAPLRERQADGSRHPFDSFICAKTPAGRWLEPEELAGPAVFLASDASNAVNGHILYVDGGILAYIGKQPK

SEQ ID NO: 1746 - protein, 252 aa, Artificial Sequence
  Synthetic
MEKMDMLKGKTAIVTGSSKGIGREIALALAENGADLVINGNNQEQLEHVKAQIETLGSRCRVVRGDISDSNTAARLAAACMEAFGKIDILVNNAGVNSRIPFLELTEEEWRRMMGINLDGVFYCCKAVLPHMVHQQSGTIINISSTASKTAHANASICYGASKAAVNSMTQKLAYEMGPHHIRVNGICPGPIETDMSLQWTEEYRKNVVKKIPLGLLGTTKNVADVAVFLASDMAGFINGETINVNGGSYMN

SEQ ID NO: 1747 - protein, 246 aa, Artificial Sequence
  Synthetic
MLKGKCAVITGASRGIGKCIATKFAKEGANVVINYRNNEEEALKVKKELEDLGSQVLVVKADVSELEQAENLIKEAKKEFGRVDILVNNAGITKDNLIIRMKEEDFDRVIKTNLKGAFNCLKAVTPIMLKQKYGKIVNMASVVGMVGNPGQVNYCASKAGLIGMTKSLAKEIGSRNITVNAIAPGFIDTDMTKILSDDQKKKILSQIPLNKFGNVEDIANVALFLGSENSNYITGQVIHVDGGMAM

SEQ ID NO: 1748 - protein, 218 aa, Artificial Sequence
  Synthetic
MRVLITGTSSGIGRGIADKFLEEGHTVTGIDRREGSIQKDGYTHICMDIRDKAKYPELEPFDIVINNAGVQNEDDIDVNLKGTIGITEKYGIHPGIKAVLMIGSASGHNGSEFPEYVASKGGVLSYAKNIALRIAKYGATCNSLDFGGVLTELNKPVMEDRALWNEIMKQTPLKRWMTVEEAADWAYFMTVTNRFCTGQNILIDGLEAGNAHFVWPEK

SEQ ID NO: 1749 - protein, 265 aa, Artificial Sequence
  Synthetic
MKNYALITGASKGIGLELAKLFAKDGYSLVMVARSNDLLEKLKEEFTKEYGVDVVCIAKDLSNPSSAKEVYDETGKLGLRIDYLVNNAGFGDYGPFLDCNIERHDNMIQLNITTLINLCYYYGRDMRINHFGKIINIGSIASFFSGPLMSTYYATKAFVLSFSEALSKELKDDGVTVTVICPGTTATNFFDVANASSDKTNLLKKMHPASPVAVAKYGYQKAMKNKVIAIYGAKNRTAIFFNRFISRRLSRSIVYKIQSERKESN

SEQ ID NO: 1750 - protein, 252 aa, Artificial Sequence; identical to SEQ ID NO: 1574
  Synthetic

SEQ ID NO: 1751 - protein, 246 aa, Artificial Sequence
  Synthetic
MLKGQTAVVTGGSRGIGRAIALELAEQGANVVINYHGSTEKAEAVKHEIEEKGGTAEIMQCNVADFEESEKFFQQVIEKYKRIDILVNNAGITCDGLLMKMSEKDFDTVMNTNLKGTFHCIRFVARQMIKQRYGRIINISSVVGVAGNAGQANYAASKAGVIGLTKSAAKELASRKITVNAIAPGFIETDMTKVLPDKVKEDSIEKIPLGYYGKPEDVAGAVAFLASDKAGYITGQVLHVDGGMVI

SEQ ID NO: 1752 - protein, 217 aa, Artificial Sequence
  Synthetic
MRVLITGTSSGIGKAIAEKFLKEGFDVTGFDRKAASIVQEHYTHFCLDIRDKKQYPSLAPFDIVINNAGVQNEDDIDINLKGTIAITESYGIHAGIRAVLMIGSASGHTGAEFPEYTASKGGVLAYTKNVALRIAPYGGTCNSLDFGGVLTELNLPVMEDKKLWDQIMDLTPLKRWMTVKETADWAYFMTVTNRFCTGQNILIDGLEAGNAHFVWPD

SEQ ID NO: 1753 - protein, 265 aa, Artificial Sequence
  Synthetic
MSVNFSLEGKIALVTGASYGIGFAIASGMAKAGATIVFNDIKQELVDKGLAAYKEAGINAHGYVCDVTNEAAVNELVEKITKEVGPIDILVNNAGIIKRIPMIEMTAEQFRQVIDVDLNAPFIVSKAVIPSMIERGHGKIINICSMMSELGRETVSAYAAAKGGLKMLTRNICSEYGQYNIQCNGIGPGYIETPQTAPLRERQADGSRHPFDQFICAKTPANRWLKPEELAGPAVFLASEASDAVNGHILYVDGGILAYIGKQPQ

SEQ ID NO: 1754 - protein, 252 aa, Artificial Sequence
  Synthetic
MRIIAITGASGGVAQAIINQLPSEDYVIALGRDKATLESLYGKRPHTTCWSLDLSNDAEIAAIVERMYDLHGRIDVFINNAGYGNFNAFDAYTTADIRAMFEVNTFATMTFSRLVGQRMKAAKRGHIITIASMAGLMASAKSSVYSATKFAVIGFSNALRLELADSNVYVTTINPGPIATSFFDKADPSGEYLKSVGRFVLQPEEVARRTVAILGKNKREVNMPWSIAAAHKFYTLFPKIADFLARKVFNYK

SEQ ID NO: 1755 - protein, 246 aa, Artificial Sequence
  Synthetic
MLDFTGKTALVTGATGGIGRQIVKKLHAQGATVAMTDMNKDALEAFKAELGGERLYTYTANLTDSESLKKLVQDAEKDMGKIDILVNNAGITKDGLSMRMTDEQWQMVLDINLTAGFKLARAVMPGMMKRRYGRIIGMASVVGVMGNAGQANYSASKAGLIGMSKCIGQEVASRGITVNCVAPGFIKTPMTDVLSDEAKAKLTATIPMARLGLPEDIANAVLFLASDEASYITGQTIHVNGGMAMI

SEQ ID NO: 1756 - protein, 217 aa, Artificial Sequence
  Synthetic
MRILITGTSSGIGKAIAEKFLKEGHDVIGFDIKPASITHSKYTHICMDIRDKADFPEFAPFDIVINNAGVQNSNDIDVNLKGTISITEKYAIHPAIRSVLMIGSSSGHTGSEFPEYAASKGGVLAYAKNIALRIAKYGATCNSLDFGGVATELNRPVMDDKNLWNQIMEQTPLKRWMGVDEAADWAYFMTVTNRFCTGQNILIDGLEAGNAHFVWPE

SEQ ID NO: 1757 - protein, 265 aa, Artificial Sequence
  Synthetic
MDKNSFSLKGKIALVTGASYGIGFAIAKGFAAAGATIVFNDIKEELVEKGLASYKECGIEAHGYVCDVTKEDQVNDFVAKVEKEVGIIDILVNNAGIIKRIPMCDMTADEFRQVIDVDLNAPFIVSKAVIPSMIKKGHGKIINICSMMSELGRETVSAYAAAKGGLKMLTRNICSEYGEYNIQCNGIGPGYIATPQTAPLREKQPDGSRHPFDQFIIAKTPAARWGDPEDLAGPAVFLASDASNFVNGHVLYVDGGILAYIGKQP

SEQ ID NO: 1758 - protein, 252 aa, Artificial Sequence
  Synthetic
MNRLQGKTAVITGGNSGVGAAAAILFASEGANVVISARRQNALDEVAEKIKAAGGNVLTVPTDISKDGDCKALMKAAADKFGKIDILINNAGVLDTGLKAIDKYLDDDAEKVIAINEVGTMQCIRAALGHMESGASIVNVASVAGYNGGGGAVYVASKAAIIGITKHTAMLLANKYIRCNAVCPGNIVTPMTMGLNPAQLDLNMMGAMNKHGDLSLKSCQAEDVANILLFLASDESKALTGQIMVSDFGVNL

SEQ ID NO: 1759 - protein, 246 aa, Artificial Sequence
  Synthetic
MMNGKTALVTGASRGIGRAIALRLAREGMNVAIVYAGNTAAAEETAQGVREAGAQANCYACDVADEAAVGALCKRVAAEMGPIYALVNNAGITRDKLAAQMKEEDFDAVLDVNLKGAFHFIRHTYSGFLRQRAGRIVNISSVVGLMGNAGQANYAASKAGLIGLTKSIARELAPRGITVNAVAPGFIDTDMTRVLPEAAKDALTAQIPLKRLGSAQDVAEVVAFLCSDGAGYLTGTVIPVDGGMAM

SEQ ID NO: 1760 - protein, 216 aa, Artificial Sequence
  Synthetic
VVINYNNSERQAKLLQQSLAAQGRKCLAVGANVAYPNEVASMVKQAEYAFGKIDVLVNNAGIAQQKLFQDITDEDWNNMLSVNLTGVFNCCRAVLPNMLREKNGAIVNVSSIWGITGASMEVHYSAAKAGIIGLTKALAKEVGPSGIRVNCVAPGVVETNMNRDITLETMSRLTEETPLGRIGSPFEIAETIYFLANDGASFITGQVISPNGGIVV

SEQ ID NO: 1761 - protein, 265 aa, Artificial Sequence
  Synthetic
MSVNFSLEGKVALVTGASYGIGFAIASGMAKAGATIVFNDIKQELVDKGLAAYKEAGIDAHGYVCDVTNEDQVNEMVAKIAKEVAPIDILVNNAGIIKRIPMCDMTAAEFRQVIDVDLNAPFIVSKAVIPSMIERGHGKIINICSMMSELGRETVSAYAAAKGGLKMLTRNICSEYGQYNIQCNGIGPGYIETPQTAPLRERQADGSRHPFDQFICAKTPANRWLKPEELAGPAVFLASEASDAVNGHILYVDGGILAYIGKQPQ

SEQ ID NO: 1762 - protein, 252 aa, Artificial Sequence
  Synthetic
MERLLSNKVCIITGAAQGIGKSIAERYAGDGAIVYACDRQEGSMEEWAEQCAAANDTRVIPLYFDVTDAAAVKSAFMSVFKQEGRIDVLVNNAGVVFNKKIGMIVRPETELMFRVNVIAVIEMVQLVSRLMARGKGGSIVNIASVTAVLGSPGQSAYSATKGAIMSFTKSAAKELAGLGIRVNAVAPGIVKTERFSELYEESGEKIDTRIQKIALGRLGTPEDVANACAFLASDRASYISGQILGVDGCASI

SEQ ID NO: 1763 - protein, 246 aa, Artificial Sequence
  Synthetic
MLTDKIALVTGAGRGIGKAIAVELAANGAYVIVNYNGSVKAAEDTVSEIVAAGGKAEAMQCDVSDFEACGEMIKAIVEKHGHVDILVNNAGITRDGLLMKMSEEDFDRVLDINLKGTFNTIRHLSRQMLKQRSGKIINLSSVSGILGNAGQANYSASKAGVIGLTKSVARELASRGIQVNAVAPGFVTTDMTDVLSDRAKEGILAQIPLQRAGTVKDIAKAVLFLASEDSDYITGQVLSVDGGMAI

SEQ ID NO: 1764 - protein, 215 aa, Artificial Sequence
  Synthetic
MKKKLSKKNIVITGASGDIAQALIQRLEGHNLILISRSLPQPVIPDKVDILINNAGFGEFSALTNLSDEQIDEMFKVNTLDLVKRTRDLQPQLQVINIASIAGKLPTAKSTVYAASKAAVLAFSDALRLEIPGLIVTTVNTGPVLTKFHKGNADYLEKVGKNAVSADYVAGKIEQVLGKNKREMNLPPQLAFVAKVRALFPALVDNIGNKFFNYK

SEQ ID NO: 1765 - protein, 265 aa, Artificial Sequence
  Synthetic
MSSETKIWRLTDRNTEGNMNLTGKVTLVTGASRGIGRQIALTLAGYGATVIVNYNGSAAKAEEVVNEITANGGTAESMQCSISDFEKSKEMIDGIVKKYGRLDILVNNAGITKDNLIMKMSEDDFDAVIATNLKGAFNCIKHVSRQMLKQRGGRIINISSVSGVMGNAGQANYCASKAGIIGLTKSVARELGSRGITANAVAPGFIRTEMTDVLPEDVKKAMGEQIPLKRFGETKDIAEAVAFLASDEAAYITGQVLQVDGGMAM

SEQ ID NO: 1766 - protein, 252 aa, Artificial Sequence
  Synthetic
MDKIVFITGASSGIGAGCARKFASEGASLILNARSVDKLNSLKEELEQKYGTKVYLLPFDVRDRKRAGEALDSLPDEWKAIDILVNNAGLVIGTDKEHEGNLDEWDIVIDTNIKSLLAMTRLVVPGMVERGRGHIINIGSIAGDAAYAGGSVYCATKAAVKALSDGLRIDLVDTPLRVTNIKPGLVETNFSVIRFRGDKDKADNVYKGIRPLTGDDIAETVYFAASVPEYMQIAEMLVMPTYQATGTIVSRK

SEQ ID NO: 1767 - protein, 246 aa, Artificial Sequence
  Synthetic
MLTDKIAVVTGASRGIGREIAKTLASKGAVVIVNYNGSTAKAEEVVKEIEEAGGRAEAMQCNVSDFESAGEMLSAVVKKYGRVDILVNNAGITRDGLLMKMTEADFDAVMDTNLKGAFNCMQHVSRQMLKQRSGRIINMASVVGLMGNAGQANYGASKAGLIGMTKCVARELASRGITCNAVAPGFIVTEMTDVLSDAVKEAMVAQIPLKKFGTTQDVAKTVAFLASDDASYITGQVISVDGGMHM

SEQ ID NO: 1768 - protein, 208 aa, Artificial Sequence
  Synthetic
MGKIILCRGKKADTPLTVLQTGVKLPEINVHQTVQHLQIHVIEQCPHRKARIADEHIQPAVLPDGRVDQIAALLRLGHIHRAVGRFAAFGSDISDDELQFLQAPGAEHHVGTLHRTFAGQCLADPRRSSGDHDGLSFQTFHPINRLHLFPIRRKPNIPLRATTRNARRKDPFHATYASDTPGGAPHGGSAPMLRPVKNANHGAGAGAH

SEQ ID NO: 1769 - protein, 265 aa, Artificial Sequence
  Synthetic
MGQVAIVTGGSSGIGAAAAEYLAAHGCTVYEFSRHEKSGGSASVHHVTADVTDEASVAAAVQSVLDAEGRIDILLNNAGFGISGAAEFTSVEEAKRQLEVNFWGMVRVTRTVLPVMRAQRSGRIVNTSSVAAVTPIPFQTYYSVSKAAINSFTMSVGNEVRPYGIRISAVMPGDTRTGFTDARARSFAGDDAYGGRISRSVAKMEKDERGGVSASVVGAALGRAALSKSRKVFCTVGFVYRLVIFLMRLLPSTAANAILGKMYAE

SEQ ID NO: 1770 - protein, 252 aa, Artificial Sequence
  Synthetic
MDKIVLITGASSGIGAGCARKFASKGARLILNGRNLEKLESIKQEIETTYHTQIYLLPFDVRDRKAASTALSTLPEEWKAIDILINNAGLVIGTDKEQEGNLDEWDIVIDTNIKSLLAMTRLVVPGMVERGRGHIINIGSIAGDMAYPGGSVYCATKAAVKALSDGLRIDLVDTPLRVTLIKPGLVETNFSVVRYRGDKAQADHVYEGIHPLNGEDIAETVYFAASVPEYMQIAEMLVMPTNQATGTIVHRK

SEQ ID NO: 1771 - protein, 246 aa, Artificial Sequence
  Synthetic
MLNGKVAVVTGASRGIGRAIAIKLASEGAAVVINYNGSKERAEEVKKEIEENGGKADIRQCNVSDFHACEEMFKEIIETFGRVDILVNNAGITRDGLLMKMTEEDYDAVLDTNLKGTFNCIRFVARQMIKQRGGRIINMASVSGVLGNAGQANYSASKAGVIGLTKSAARELASRGITVNAIAPGFINTEMTEVLSDKVKEGAVAQIPLGKFGETEDIANAAAFLAGDGARYITGQVLNVDGGMAI

SEQ ID NO: 1772 - protein, 207 aa, Artificial Sequence
  Synthetic
MKVLITGAASGIGKGCAELFLKENHEVYGFDKNISSIQHPKYTHFCLDIRDKNSYPEIGPVDILINNAGVQNGDDIDVNLKGTISVTEHYGIHPNIYSVIMIGSASGHTGSEFPEYAASKGGVLAYTKNVAMRIAPYQATCNSLDFGGVMTELNRPVMEDKKLWNQIMELTPLKRWMSVEEAAEWIYFMAVSLFGGKPLPLQLKTRY

SEQ ID NO: 1773 - protein, 265 aa, Artificial Sequence
  Synthetic
MFNKEVVVRCESGLHNRQATYFVQKANEFESSIWLESGSRRMNAKSLLGIMSLGVVTGTTVTLSASGPDAEAAVNALVAKIEEEVGAIDILVNNAGIIKRIPMCEMTAEQFRQVIDVDLNAPFIVSKAVIPSMIKKGHGKIINICSMMSELGRETVSAYAAAKGGLKMLTRNICSEYGKYNIQCNGIGPGYIATPQTAPLREIQPDGSRHPFDKFIIAKTPAERWGDAADLGGPAVFLASDASNFVNGHILYVDGGILAYIGKQP

SEQ ID NO: 1774 - protein, 252 aa, Artificial Sequence
  Synthetic
MGRLDNKIAVVTGANSGVGAAIAKLFAAEGAKVVMTARREAALEEVSAEIQAAGGETLVVPTDISKPEDPERMMAAAEEKFGQIDILVNNAGILESGLKPVDRFTDEDLDRIIETNQKGTMRCMRAATKRMKAGASIVNIASVAGEKGCGGAVYVSTKAAVIGVTKHTALRFQATGIRCNAICPGTIVTPMVAGTTAADMDPDMMGAMAAHSNLQTQPCMPGDVANIALFLASDESRALTGQILVSDFGAML

SEQ ID NO: 1775 - protein, 246 aa, Artificial Sequence
  Synthetic
MGKLDGKIALITGATSGMGEAFARLFSQEGAEVVLVGRNEARGMKICREIELDGGKANFLECDVSQEENVKSLRYSFEHNYDHLDILVNNAGILRTSPLEEISAEEWHQVFATNTDAVMYMSKHFFDLIIRAHGNVLNIGSDVGMHSNVKGRSNFAYACSKAAMIQFTQLCALNYSDRIRVNCLCPGTTETPIFTNRDFSRFNASIPMGRVAKPMEIARAALFLVSDDASYVTGAVLPVNGAASLR

SEQ ID NO: 1776 - protein, 201 aa, Artificial Sequence
  Synthetic
MRFENKTAVVTGGSRGIGLAIATKLAKEGANIAILYVGDENEGIKAKEELSQYGTKVEQYFCDVSNFEESKKVVDKVIEDFGSIEILVNNAGITRDKLVLNMDEKDFDAVINVNLKGTFNMIKHTYKHFMKKRYGRICSTASIVGLTGNAGQANYSASKAGIIGLTKSVAKELAGRGVTANAVAPGYIASPPSTLITSPVT

SEQ ID NO: 1777 - protein, 265 aa, Artificial Sequence
  Synthetic
MIESLEHAFSLKEKVVLITGGNKGIGKGISLAMAQSGASVAIMCRNLASAAETIEELEQFGGVHRAYEGDVTKQEDAKRVVAKVVEDYGRIDVLVNNAGIATPFDPMEDTDDLSGWYRVLDVDLNGTFLMCHYAGLKMKEQNGGRIINITSNSSRIVNIPQKSCSYNAAKAAGDRLTKCLAYEWAQYGIRVNAIAPGYTETNLVTGVKDEGETKGWTDYWLSCTPTGRFGKPIEIGAAAVYLASEAAEQVTGAVLTIDGGYMLAR

SEQ ID NO: 1778 - protein, 252 aa, Artificial Sequence
  Synthetic
MEFNHKTVLVTGAGGGSGKAIAETFLRSGANVIAADLKLPLWHEPTDMFHPVAMDVSMEDAVEKVVSEYCSKYGCIDILVNNAGIAIESPLIDFQLDVWQKIFKVNAEGTFLCTRAVTRCLVEKKIPGRIINIASIAGKNGFPNSSAYCASKAAVIGFTRALAAELGQYGITVNAICPGSVATPMIESVINTISANSGMSKPEVRTMMESGIPLKRFQEPQDVANLVCFLASDYAGNISGESMNLDGAVIRD

SEQ ID NO: 1779 - protein, 246 aa, Artificial Sequence
  Synthetic
MLTGKIAVVTGASRGIGKEIAKTLAAKGATVVVNYNGSAAKAEETVKEIEALGGKAEALQCNVSEYDKAAEMMEYVVKTYGRVDILVNNAGITRDNLLMKMSEEDFDAVLNTNLKGAFNCIKHISRQMLKQKSGHIVNISSVSGVMGNAGQVNYSASKAGVIGMTKAVAREMASRGITCNAVAPGFIKTDMTDVLSDTIRENINAQIPMRTFGETADVANLVAFLASDEAKYITGQVICVDGGMAI

SEQ ID NO: 1780 - protein, 198 aa, Artificial Sequence
  Synthetic
LEALGVKAKAYASNAANFEDTANVVAEIHKDFGRIDILVNNAGITRDGLMMRMSEQQWDMVINVNLKSAFNFIHACTPIMMRQKSGSIINMASVVGVHGNAGQCNYSASKAGMIGLAKSIAQELGSRGIRANAIAPGFIITDMTAKLSDEVKAEWAKKIPLRRGGTPEDVADVATFLASDMSSYVSGQVIQVDGGMNM

SEQ ID NO: 1781 - protein, 265 aa, Artificial Sequence
  Synthetic
MANRLLGKSAVVTGAASGMGKAIALAYLREGANVAATDMNEARLKELEQEVTELGLSDHFCCCAGNITVDEDCAAVVKLCADRFGICNVLSHNAGVVDDFTMVDSVDNGKWDKVIAINLTGAMKVARAALQYFLANEIKANIVMITSNAAFESVTGGPAYCASKAGANALMKSIAFEYGRKGIRCNSICPGPVGTNISESAPDRNPAGVEVHIKTGYNAHCREWTCMPLGKADDIAPLAVYLASDESRFMNSASIVIDAGVCLSH

SEQ ID NO: 1782 - protein, 252 aa, Artificial Sequence
  Synthetic
MSENIFSLEGKTILVTGASSGIGRGIALQCAEMGASVILNGRNMERLNETLGMMKTGNHVIMAADLSKQEEIEMLVNELPEIQGWVNSAGMPKICPIKRFKLLDIEEIMSVNTISSMMLLSFLLKNKKIKRGASVVFISSISGVYVGTAGDTSYCASKGAVNGFTKGAAIELAPQGIRVNSINPGLIPTNILAMADSITSGASLVDKMTEKYPLKRLGKPEDIGNGAVYLLSDASSWVTGQNLVIDGGFSVG

SEQ ID NO: 1783 - protein, 246 aa, Artificial Sequence
  Synthetic
MLAGKVALVTGASRGIGKAIACKLAREGAKVIINYNGSKEKAEAVKSEIEAAGGQAEVYQCDVSDYTACETFIQTVIKEEGSLDILVNNAGITKDGLLMKMSEEDFDKVLDTNLKGAFNTIRFASRQMLRQKGGRIINMSSVVGVSGNAGQANYAASKAGVIGLTKAAARELASRGITVNAIAPGFIETDMTDVLSDKVKEASEAQIPLGHFGKPEDVAAAAAFLASEEARYITGQVLHVDGGMVM

SEQ ID NO: 1784 - protein, 194 aa, Artificial Sequence
  Synthetic
MSKNVLITGATSGIGEATARAFAKEGENLILTGRRVERLEALKEELQATYPNQKVWTFALDVTDMAMVKDVCQAILKSVGQVHVLVNNAGAAVYSATKAAVKTFSDGLRIDTIATDIKVTTIQPGIVETDFSQVRFHGDKDKAAKVYQGLEALQAQDIADAVLYVTKQPRRVQISDMTIMANQQATGFTIHREE

SEQ ID NO: 1785 - protein, 265 aa, Artificial Sequence
  Synthetic
MADRIKGKVVLITGASAGIGRACAQEFARRGAKVVCLARRTAEGFDSISADVTDRAAVFAAVEEVKARYGRIDVLVNNAGMGISGSVEDTAYADARAIFDVNFFGALNLIQAVVPVMRDSGGGTIINMSSVAAELSIPFQSFYSATKAAVLSLSQALRSEVAPFNIKVTALLPGDVKTDFTSSRRKNAQNNPAYAGRVERSVAVMERDERGGLPPEAIARTAVRLANSKNPPVKASGGKKYALFLFLAKILPSRLVSYIIGKMYA

SEQ ID NO: 1786 - protein, 252 aa, Artificial Sequence
  Synthetic
MKLENKIAIVTGAGSGMGKAIAALFAKEGAKVIASDINEVGVKELIASAGDIAGEIVFSQTDVSNRNQVEAMIDLAVNKYGKLDVLVNNASILDQMYSVTEVEDEFWNKVMSINVNSVMYACRKAIPIMMKNGGGSIINTASVGGLFGCRAGAAYTASKFAVVGLTKNIGFMYAKEGIRCNAICPGSIITNIAAGLSNASEFGMARSGAGVPLSPRMGQPEEIANTALFLASDEASFINGTTVTVDGGWTAY

SEQ ID NO: 1787 - protein, 246 aa, Artificial Sequence
  Synthetic
MELLRGKAAIVTGASRGIGLGIACALAREGADLVVHATREEHLEPVRAQAERWGVRCVTAAGDVAQPETARLLTQIALERLGRLDIAVSCAGVNQDGMLHRLSDEAWERVLAVNLSGVFYLTRSAAQVMRAQRSGRIINISSVARNGNLGQSNYAAAKAGVAALTQTAALELGPFGVTCNTVCPGFIDTDMTRGVPDAARERMLSRIPARRSGRPEEVGDAVAFLASDRAAYINGQTLDVSGGLIL

SEQ ID NO: 1788 - protein, 191 aa, Artificial Sequence
  Synthetic
MDPTRGNGIDRDVERSQGDGQRMGQRVDAALRSGVGLGSGLALQVAGRAEVDDAAIVVVAVLLAVERQLAGGDEDRAQVGGDYPVEFLDRQFGEGLEGADPDVVHQDIDVAPGLEELPHASFEADGIGNIQLTEPGAGFGCGLGAEDGIDVAEDHFITLPGKGLDNSLSDSVGTARNEYASFHGFRIFPQR

SEQ ID NO: 1789 - protein, 265 aa, Artificial Sequence
  Synthetic
MSIDFSLNGKIALVTGASYGIGFAIASGMAKAGATIVFNDIKQELVDKGLAAYKEAGIEAHGYVCDVTNEDAVNEMVAAIEKEVGVIDILVNNAGIIKRIPMCEMTAAEFRQVIDVDLNAPFIVSKAVIPSMIKKGHGKIINICSMMSELGRETVSAYAAAKGGLKMLTRNICSEYGEYNIQCNGIGPGYIETPQTAPLREIQPDGSRHPFDQFIIAKTPAARWLKPEELAGPAVFLASEASNAVNGHILYVDGGILAYIGKQPK

SEQ ID NO: 1790 - protein, 252 aa, Artificial Sequence
  Synthetic
MEFKNKTVLVTGAGGGSGKAIAEAFLKAGAVVIAADLKIPQWHEATDMFHPVSLDVSEEVAVDKVVSEYCEKYGCIDILVNNAGIAIGSPLIDFTLDIWQKNFKVNAEGTFLCTRAVVRYMVKKNVPGRIINIASIAGKNGFANSSAYCASKAAVIGFTRALALELGPYGITVNAICPGSVATPMIESVIDTISSNSGMSKTEVRTMMESGIPLKRFQEPEDVASLVCFLASDYGSNISGESMNLDGAVIRD

SEQ ID NO: 1791 - protein, 246 aa, Artificial Sequence
  Synthetic
MLAGKVALVTGAGKGIGCQIAKTLASYGATVVLNYAHSKDAAEETAKEICENGGKASVYGCDVADFDAVAEMIKTVAKEQGSIDILVNNAGITKDNLTMVMKEEEFDAVINTNLKGAFNCMRHVTRQMLRQKGGHIISISSIVGLVGNAGQINYSASKAGVIAMTKSLAKELGGKGITVNAVAPGFIDTDMTRVLKEDVREKMMAQIPLNRLGSTQDIAETVAFLASDKAAYITGQTISVDGGMYA

SEQ ID NO: 1792 - protein, 183 aa, Artificial Sequence
  Synthetic
MAILDKFSLEGKIALVTGASYGIGFAIATAYAEAGATIVFNDIKQELVDKGIAAYEEKGIKAHGYVCDVTDEEQVNELIAKIEKEVGVIDILVNNAGIIKRIPMCEMKASEFRQVIDVDLNAPFIVSKAVIPSMIKKGHGKIINICSMMSELGRETVSAYAAAKGGLKKPNEDIYVFEEDIEE

SEQ ID NO: 1793 - protein, 265 aa, Artificial Sequence
  Synthetic
MGANFSLEGKVALVTGAAYGIGFAMAKGLAEAGASIAFNCRSKEHMDQALADYEKAGIKAKGYICDVTVEEDVQKMVADIEATMGTIDILVNNAGIIKRIPMHEMKAEEFRQVVDIDLNAPFIVSKAVIPGMMKKGHGKIINVCSMMSELGRETVSAYAAAKGGLKMLTKNIASEYGEYNIQCNGIGPGYIATPQTAPLREMQPDGSRHPFDQFIVAKTPQARWGTPEDLVGPTVFLASDASNFVNGHILYVDGGILAYIGKQPK

SEQ ID NO: 1794 - protein, 252 aa, Artificial Sequence
  Synthetic
MKRIALITGASSGIGEACARKFAEGGYSLILTARRAEKLAGLKAELEAEGTKVKTLTFDVRDAEAAETAVDSLEPEWRKIDVLINNAGLALGLDKEYEGDPDDWNAMIDTNIKGLLTMTRLIVPGMVERNEGHVINIGSVAGDAAYAKGNVYCATKAAVKTITDGLRIDLAETAVRVTNLKPGLVETNFSNVRFHGDNQRADNVYKGITPLTGADIADVAFYAASAPKHVQIAEVLILATHQASGSVIYRKP

SEQ ID NO: 1795 - protein, 246 aa, Artificial Sequence
  Synthetic
MDKLKGKVALITGGTSGIGAASAELMAKEGADVIVVGRNEERGNSFNRTMKQNGLSVEFFDCDVTNTEDIQRLQQFVNDAYGCLDILMNNAGILLTGTLEEITDEDWDCSYAVNVKATMHMCKRFIGLLQKNYGVIINNASNVGLQHYIKGRSSYMYATSKAAVIQFTRHLARNYAPRVRVNALCPGVTTTNIFTNRDFSRFDDVNLLGRMARPEEIAKAVLFLASDDSSFMTGSILVVDGGESIK

SEQ ID NO: 1796 - protein, 182 aa, Artificial Sequence
  Synthetic
MSSYDDMMNFVGEVKEKAGHVDWLISNAGISTYDKFQDYTFEEWNKIVNTNLSVPVFMVKEFMPVMTEGGRVLFMGSYAGQQAYSSSLVYGVTKAAIHFLTKSLVKEFEPKGITVNAIAPGFIKTDMTDVLSDKVKENISASIPMGSMGTAEDVAKAAAFLASDGARYITGQVLRVDGGMAM

SEQ ID NO: 1797 - protein, 264 aa, Artificial Sequence
  Synthetic
VFGGIFMVAVITGASGGIGKETARVLLREGWQVICLQRHDCDLPGAENIKCDITDQADIDSAFSKIEKIDLLINNAGFGVSGCVEFTDMGEIRAQFELNFFAHIAVTKAALPKLRESRGRVIFISSAASVFSIPFQSFYSATKSAVESVSLALSNELKQFGISVCAVRLGDVKTGFTAARQKDFAGDKVYGGAIARSVKVMENDEINGMRPEQVAEGIVKIAQKRRLPVLATLGGKYKVFCVLQKILPAGLVNRIVGGMYMPKE

SEQ ID NO: 1798 - protein, 252 aa, Artificial Sequence
  Synthetic
MQRTALLTGATAGFGTAICRTLIENGYRVIGTGRRVARLEQLQQELGENFHFLAFDISDRQATEDAFHSLPASWQSIDLLVNNAGLALGLESADKASLDDWMQMIDTNIKGLVTITRLVLPQMVERNSGHIINLGSIAGTYPYPGGNIYGGTKAFVKQFSLNLRADLAGTQIRVSNIEPGLCGGTEFSNVRFKGDDARAEKLYENVEYVSPQDIANIVLWLNQQPEHVNINRIEVMPTAQTFAPLNVARIQK

SEQ ID NO: 1799 - protein, 246 aa, Artificial Sequence
  Synthetic
MSENTTAIVTGGSRGIGRAVAIKLASLGTDIAVVATHDGSAAKDTIKSINDLGRKAKLYVCNISDFEAVSDTVSEIIKDFGGVDILVNNAGITKDKLLMQMSEEDISDVIDVNLKGSMYVTKACLRTFMRQRHGRIVNISSVVGLMGNAGQTNYAASKAGIIGFTKSVAREYASKGITCNAVAPGFIRTDMTDKMPEDAVKAMLSNIPAGRYGEPSDVAETVAFLVSDAAAYITGEVIKVDGGMYI

SEQ ID NO: 1800 - protein, 179 aa, Artificial Sequence
  Synthetic
MVVPSFAASRLAGIVSGKSIFNSSEASIERIMNVNTNAHFWMIREFVPDMMERNSGSVVAVSSMAGMVGTANLNDYCASKYAVVGLMESLEGELYNEGKTGVHCTLVCPYYIDTGMFAGVNPGLLPLLTPRYVVDKVALSFSSHAQMMHGIEYAEHIVTCPGWLYRTVYHILPSVIADS

SEQ ID NO: 1801 - protein, 264 aa, Artificial Sequence
  Synthetic
MVNFSLEGKVALVTGASYGIGFALATAFSQAGAKIVFNDIKQELVDKGLAAYKAEGIDAKGYVCDVTNEEQVNAMVAQIEKEVGVIDILVNNAGIIKRIPMHEMTAAEFRQVIDVDLNAPFIVSKAVIPSMIKKGHGKIINICSMMSELGRETVSAYAAAKGGLKMLTRNIASEYGEYNIQCNGIGPGYIATPQTAPLRELQPDGSRHPFDSFIIAKTPAARWGTPEDLMGPAVFLASDASDFVNGHVLYVDGGILAYIGKQPK

SEQ ID NO: 1802 - protein, 252 aa, Artificial Sequence
  Synthetic
MRIIAITGATGGLAKEIVKQLPSDDFVIALGRNVEKLEACYAERPNTVYYKLDMSSDEAIGAMVEKLYAKHGHIDVFINNAGYGDFSEFDAYTTAEIRDMFDINTFATMTFSRLVGHKMKKSGHGHIVNIASIAGLIASAKSSVYSATKFAVIGFSNALRLELADSNVYVTTINPGPIATSFFDKADPSGEYLKSVGRFVLQPEEVARRTVAILGKNKREVNMPFSMAAAHKFYTLFPKVTDFLARKVFNYK

SEQ ID NO: 1803 - protein, 246 aa, Artificial Sequence
  Synthetic
MNNSANNVVVITGASSGIGQAIALYLANKAFSLVLVARRLDRINALVDQIIQQGGKAIAVKADVTRQEEVQAAIDAAVTAYQRVDVLINNAGYMAIAPISERKTDEWDKMIDTNLKGVLYGIAAALPVFQRQGSGHFINVASVAGIKVLAPGGVVYSATKFAVRALSEGLRQEAGKTIRTTLISPGAVESELQFGSSDKDSLAFLHEFYKQAIPADAIARAVLFAIEQPGDVDINEIVVRPTQEEF

SEQ ID NO: 1804 - protein, 172 aa, Artificial Sequence
  Synthetic
LKGKTVVVTGASSGIGEALARECAVQGANVVLGARSLQKLQLIVGDIRSKGGEATYCAVDVTKPDGEKVAILSMADGTPFDMDKMYKVAVNSYRGNGGGELLTKGAGISQDELKERIIHSTDKDLRYYLMQYIEQKKVIEPRTLNQWKFIPEEWAAPASKRDYEFLFGKVKE

SEQ ID NO: 1805 - protein, 264 aa, Artificial Sequence
  Synthetic
MVNFSLEGKVALVTGASYGIGFAIATAFAKAGATIVFNDIKQELVDKGLAAYKEEGINAHGYVCDVTNEDAVNAFVAQVEKEVGVIDILVNNAGIIKRIPMCEMSADQFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGTPEDLMGPAVFLASDASNFVNGHVLYVDGGILAYIGKQPK

SEQ ID NO: 1806 - protein, 252 aa, Artificial Sequence
  Synthetic
MERFLDNKVCIITGAAQGIGKSIAERFAGDGAIVYACDRQEGSMDAWGEQCAAAQGTRMIPLYFDVTDAAAVKSAFMSIFRREGRIDVLVNNAGVVFNKKIGMIVRPETELMFRVNVIAVIEMVQLVSRLMARNGSGSIVNIASVTAVLGSPGQSAYSATKGAIMSFTKSAAKELAPLGIRVNAVAPGIVKTERFSELYEESGEKIDTRIRKIALGRLGTAEDVANACAFLASDRASYISGQILGVDGCASI

SEQ ID NO: 1807 - protein, 246 aa, Artificial Sequence
  Synthetic
MEDKKVALITGGTRGIGKAIAIKFAKNGYNLVLNYVSDKTNIENLKSEFEQYNIEISFIKTDVSKFEDCENMAKKSIEKFGKIDVLVNNAGITKDNLLLRMTPEDFEKVIDINLKGTFNVTKSVVPYMMKKRTGKIVNISSVVGVSGNAGQCNYSASKAGIIGFTKSIAKELASRNILANCIAPGFIDTDMTSVLNDNVKENINSQIPLKRMGTSEEIANSVYFLAGEENTYITGQVLNVDGGMLM

SEQ ID NO: 1808 - protein, 166 aa, Artificial Sequence
  Synthetic
MGRLEGTTAVITGASSGIGRAAYALAREGCNLVLVARREERLTEVKKKCEELGGSTVYYVGDVRCEQTAQAAVELAVSTFGKVDILINNAGIGKKITLEESTAENYREIMDTNAFSSFIFSKYAILDMLKRNEGRIVMVSSVTGHIGHADETIYTMTKFAQRGLLQ

SEQ ID NO: 1809 - protein, 264 aa, Artificial Sequence
  Synthetic
MVNFSLEGKVALVTGASYGIGFAIATAFAQAGATIVFNDIKQELVDKGLAAYKEKGIHAHGYVCDVTNEAAVNAFIAQVEKEVGVIDILVNNAGIIKRIPMCEMTAEQFRQVVDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGTPEDLMGPAVFLASDASNFVNGHVLYVDGGILAYIGKQPK

SEQ ID NO: 1810 - protein, 252 aa, Artificial Sequence
  Synthetic
MRIIAITGATGGIAQEIIKHVPEDDYVIALGRDLKKLKTHYGKRSNTEYFALDMSSDVAIAETVEKIYAIHGRVDIFINNAGYGDFSDFDTYTTAQIRDMFDINTFATMTFSRLVGQRMKEAGEGHIINIASIAGLIASAKSSVYSATKFAVIGFSNALRLELADSNVFVTTVNLGPIATKFFDKADPSGEYLKSVWRFVLQPEYVAKRTVAIFGKNKRELNMPWSLAAAQKAYTLFPRIADFLARKIFNYK

SEQ ID NO: 1811 - protein, 246 aa, Artificial Sequence
  Synthetic
MATAIITGASQGIGACIAKRLAKDGYDIAVNHFPSEGDQAKAVEVAKECEALGVKAVCYAADVSKFDQCEAMVKQIKADFGSIDVLVNNAGITKDGLLARMSEENYDMVVAVNQKSIFNMMKPVCSVMMKQRHGRVINISSVAGLYGNAGQFNYSATKAAIIGMTKTAAKEFGSRNITCNAVAPGLIRTPMTDVLSDELKAKMLEMVAMKRYGEPEEIASVVSFLASDDASYVTGQVIEISGGLSM

SEQ ID NO: 1812 - protein, 163 aa, Artificial Sequence
  Synthetic
MNSTRNYTLITGASTGIGYELAKLFAKDRHNLILVARDEGKLETAKNELSKCNVEVKILSLDLSKSEDIQGLFNYVEMNKLNVDILVNNAGIGTFGDFSEIEWVKEEALIDINIKPEVVDPDDIEMLQDLVLSAVNEALRSVDEMQASQMSKVTGGMNIPGLF

SEQ ID NO: 1813 - protein, 264 aa, Artificial Sequence
  Synthetic
MVNFSLKGKVAWVTGASYGIGFALATAFSEAGAKIVFNDISQELVDKGLAAYKELGIEASGYVCDVTSEEQVNALVARIEKEVGVVDILVNNAGIIKRIPMCEMTAEQFRQVIDVDLNAPFIVSKAVIPSMIKKGHGKIINICSMMSELGRETVSAYAAAKGGLKMLTRNIASEYGEFNIQCNGIGPGYIATPQTAPLREVQPDGSRHPFDSFIIAKTPAARWGTPEDLMGPAVFLASDASNFVNGHVLYVDGGILAYIGKQPK

SEQ ID NO: 1814 - protein, 252 aa, Artificial Sequence
  Synthetic
MSKTVLITGATSGIGRATALAFAKAGYDLLLCARRLEVLENMKAEFEPEYGIKVTPFALDVTNRQAVTETLPAVIEKAGGVDILVNNAGLAQGLDAFQESSIDDIELMINTNVKGLLYVSRTVLPFMLAKNAGHIINLGSTAGIYAYAKGAVYCATKAAVKTLSDGIRIDTIESDIKVTTIQPGIVETPFSEVRFHGDKEKAAAVYAGVEALQAEDIADIIVFAATQPKRVQISDITIMANQQATGFMIAKK

SEQ ID NO: 1815 - protein, 246 aa, Artificial Sequence
  Synthetic
MLNDKVAVVTGASRGIGRAIAVKLASLGATVIINYNGSVEKAKEVKSEIESCGGKAEVYQCDVSDFEACKTFLDHVIKEYGRLDILVNNAGITKDGLLMRMSEQDFDDVIRINLKGAFNCIRFASRQMMKQRSGRIVTLSSVVGVAGNVGQANYAASKAGVIGLTKATAKELASRHITVNAVAPGFIQTDMTEVLPEKMKEQIASQIPFGTFGDPKDVANAVAFLVSDEAGYITGQVLHVDGGMVM

SEQ ID NO: 1816 - protein, 162 aa, Artificial Sequence
  Synthetic
LQSGGGRENPFKIDMSYVERIYRINVFAPLRLCQLAVPEMEKSGYGSIVNITSMSSIDKEANMCVYSSSKAALNHLAANLAYDFGPYGVRVNNVGPGATRTAALESILTPELQEKMLKRTPINRLGEVSDIAQAVLFFASPASAWISGQVIFVNGGGDQTLD

SEQ ID NO: 1817 - protein, 264 aa, Artificial Sequence
  Synthetic
MTEEKRVAVVTGGDRGIGRGITDQLLKDGYYVVIANRNEEAGKKAVEELNAQGYEGKVVSVAGDASKKESHERFVKTAVDNFGRLDTYVNNAGIAQIKLLKDETEADMDEIFHVNVYSVLFGMQAAAAQFRKQDDGDKIRKIINASSIAGHIAFDMLGAYSASKFAIRGLTQAAAKELGREHITVNAYCPGIVGTDMWDYIDEKMVEAWGGNKGDYLKKYSGAITLGRVETPADVANYVSWLASTKSDYMTGQAVQIDGGIQFI

SEQ ID NO: 1818 - protein, 252 aa, Artificial Sequence
  Synthetic
MGRFLENKVCIITGAAQGIGKSIAERFVGDGAIVYACDLQEGSMDVWAEQCVAVQGIGVIPLYFDVTDAAAVKSAFMSIFKREGRIDVLVNNAGVVFNKKIGMIVRPETEQMFRVNVIAVIEMVQLVSRLMARNGGGSIVNIASVTAVLGSPGQSAYSATKGAIMSFTKSAAKELAPLGIRVNAVAPGIVKTERFSELYEESGEKIDTRIQKIALGRLGTPEDVANACAFLASDRASYISGQILGVDGCASI

SEQ ID NO: 1819 - protein, 246 aa, Artificial Sequence
  Synthetic
MNFKGKTALVTGAAVGIGRAAALVFAERGANLVLVDMDYEKLKDVKKETEKLGADTLIYQCDVSDEENVNSVVKSASEHFGGIDILVNNAALWRAYKGFLEMTTDEWNTYFNINVMGTVFFSKAVLPYMIENKWGRIVNVSSVAGVYGNGNMTTYSATKGAVNSLSKALAKEFSQKGILINSICPGTVSPSDNPDIDYYTENDLSVIGRTGTDRENANLICFLASEEASYISGQVIQIDGCRKILI

SEQ ID NO: 1820 - protein, 161 aa, Artificial Sequence
  Synthetic
MKAICYKAVLPFLRRQGKGHIVNISSVAAVAHIPFQTFYSASKAAVSSYSYALANEVKPYGIHVTVVELGDICTGFTKARQKSILGDDEYGGRISRSVSQMEHDEQNGMDPADIGRYIAGIVEKKKPAVVYVAGAQYKFLSLLCKLLPAAARGKIVGKIYG

SEQ ID NO: 1821 - protein, 264 aa, Artificial Sequence
  Synthetic
MEKLEGKVAVITGASKGIGEGIAKVYAKYGAKCVLAARGPKVLELAEELRKQGYEAIGVQTDVSDFQSVEKLVCTAEETYGPVDILVNNAGICVLEDFLSADSFENRDKHFDINIKGVWNTTKAVLPSMFKTGAGAIVIMSSVTGDMVADPGEVAYATSKAALVGFTKAMAREVADKKIRVNAICPGYVLTPLVEGMAKQSDPEDPKRAIQAIADAVPLGRLADPTEIGELAAFLGSSESSYITGAQIVIDGGSTLPETTSMGQ

SEQ ID NO: 1822 - protein, 252 aa, Artificial Sequence
  Synthetic
MKMQGKSVVVTGASSGMGDAIVRLFASEGAQIIAVARRKERLESLKESLAEAPGTVEIYPGDVSDQSICEGMIDFAVEKFGKLDVLVNNAGIMDDMSPIGDATNEKYEQVLKVNTFGPFCSMRKAVQVFLEQGNGGTIVNVASLGGMRSCAGVIYCASKAAVISMTKNTAYMYMKDGIRANAIAPGGIASEIATSMGQPNPNGYGRIQPVLACGPEMGSTEDIAKAALFLASEDSAYINGDVLIVDGGWNAG

SEQ ID NO: 1823 - protein, 246 aa, Artificial Sequence
  Synthetic
MLKGKTALVTGASRGIGREIALTLAKYGADVIVNYHGSGEKADEVVKAIEKMGRRAKAIQCSVADYEACRRMTEEALSEFGRIDILVNNAGITRDNLMIKMSQEDFDSVLHTNLKGTFCMMKHLYRPFIKQRAGRIINLASVTGLLGNPGQANYAASKAGVIGLTKSAARELASRNITVNAVAPGYIDTDMTRAMTETAKEGVLSQIPLGREGRPEEVAEVVAFLASDKAAYITGQVISVDGGMYM

SEQ ID NO: 1824 - protein, 160 aa, Artificial Sequence
  Synthetic
MNRLEKKVAIITGAAMGQGAAEAYLFAKEGAKVVATDMCEDILRETVQKINEDFSHSTIALKLNVTDEEEWKKVVEECINQFGTVDILLNNAGIGSKGINYDKTDYQAFENVMKINAWGPFVGMKTVAPIMIKNKKGSIINVSNVDPMSRTINKKVLKFE

SEQ ID NO: 1825 - protein, 264 aa, Artificial Sequence
  Synthetic
MSNMFSLEGKIALVTGASYGIGFAIACAMSDAGATIVFNDIKQELVDKGIAAYAEKGIKAHGYVCDVTDEAAVNALVAKIEEEVGVIDILVNNAGIIKRIPMCEMTAEQFRQVIDVDLNAPFIVSKAVIPSMIKKGHGKIINICSMMSELGRETVSAYAAAKGGLKMLTRNICSEYGKYNIQCNGIGPGYIATPQTAPLREIQPDGSRHPFDKFIIAKTPAERWGDAADLGGPAVFLASDASNFVNGHILYVDGGILAYIGKQP

SEQ ID NO: 1826 - protein, 252 aa, Artificial Sequence
  Synthetic
MGALFSTDAFAGRVVLVTGASRGIGKSIAEIFNEAGARVIGTATTEGGAQKITEALAGSGKGVIFDVTDATAADALIQSIVKDEVKIDILVNNAGITRDALSMRLTDENWNAVLEADLTGAFRLVRAALRPMMRARYGRIVNLASVVGVTGNAGQANYAAAKAGLIAMSRSVAREVAARSITVNCVAPGFIETDMTKTIPEAMRETLLKEIPAQRFGKPEDIAQAVLFLASDAASYITGAVLHTNGGLYTGY

SEQ ID NO: 1827 - protein, 246 aa, Artificial Sequence
  Synthetic
VEERKVVFVTGGSRGIGKAIALKYAQNGYNVVINYVSDKTNVEELQKEFTKLNVECLIEKADVSKSEEVEKIVKKAIEKFNKIDVLVNNAGITRDGLLMRMKEEDFDKVIEINLKGTFLITKSVIPYMLKKRDGKIINLASVVGVTGNAGQCNYSASKAGIIGFTKSIAKELASRNIRANAIAPGFIDTDMTSILSDEVKDSINVQIPMKRMGTTQEIANVAYFLGCEESSYITGQVINIDGGMVM

SEQ ID NO: 1828 - protein, 155 aa, Artificial Sequence
  Synthetic
MLNEKIAVITGASRGIGAAIAKKMAENGATVIINYQGSVQAAQALEAEIREKGGKAVTYKCDVSDFDKCEKFIGDVVKEYGRIDILVNNAGITRDGLLMGMKEEDYKFYLDLRKYGSARHAGFGLGFERCVMYLTGMANIRDVIPFPRTVNNCEL

SEQ ID NO: 1829 - protein, 264 aa, Artificial Sequence
  Synthetic
LSRRRFIIDLKKLFGYEGKTVVITGSASGMSKAATELLLELGANVYAIDINKIDLPVTKAFQADMSQKEEIDRVIEELPEKIDALFLCHGIAAFPGKELLVQKVNFYSQKYMTEKLLDRISEHGSVTYISSVGGFGWQQVYSKAVELINLPTWEDAMDWYDKHPDLIKSAYVFAKQCLESYVTYKCMSSEFINKRIRINAINPGDTTTGLTEDFNKSTSPNGDAKEGEEMISNIFLKSWNGYPAEPKDMGYPMVVIGSDICSYM

SEQ ID NO: 1830 - protein, 252 aa, Artificial Sequence
  Synthetic
MNRLEGKVAVVTGANSGVGAAIAKLFAAEGAKVVMSARRVAALEEVSAEIEAAGGETLVVPTDISKPEDPENLMAAAVEKFGKIDILVNNAGVLEKGLKPIDRFTDEDLDWIVETNQKGTMRCMRAATKRMEAGASVVNIASVAGEKGCGGAVYVSTKAAVIGVTKHTALRFQSAAIRCNAICPGNIITPMTMGTNPADLDPDMIGAMMTHSNMKTPSCTAEDVANIALFLASDESRALTGQIIVSDFGSML

SEQ ID NO: 1831 - protein, 246 aa, Artificial Sequence
  Synthetic
MERKTAIITGAARGIGRATAIKLASAGFNIVVNYCGSEQAARESEVLCKESGAETLVIRGDVAREEDCARIAEETLARFGSIDVLVNNAGITRDGLLMRMEEKDFMAVIDTNLKGTFLMTKAVSRQMLKQRSGRIINLASVVGIAGNAGQVNYSASKAGIIGLTKSFALEVAAKGITVNAVAPGFIKTDMTDAMTDAAKENVQGSIPLRRMGTAEDVADVIAFLAGDESSYVTGQTICVDGGMCMR

SEQ ID NO: 1832 - protein, 152 aa, Artificial Sequence
  Synthetic
MRLENKVAVVTGASSGMGKAITTRFVQEGAKVVAVARRIERLEELAESLKGEPGEIEIFSADITSVDKNNEMIDFAVEKFGHLDILVNNAGIMDDMSPVGDMTDEMLDRVMKINGYAPIYAMRKAVLDIGIENMFISPRLFFQDGRVPRSIF

SEQ ID NO: 1833 - protein, 264 aa, Artificial Sequence
  Synthetic
MVNFSLEGKVALVTGASYGIGFAIASAFAAAGATIVFNDIKQELVDKGLAAYQEKGIKAFGYVCDVTSEEQVNALVAQVEKEVGVIDILVNNAGIIKRIPMCDMSAAEFRQVIDVDLNAPFIVSKAVIPGMIKKGHGKIINICSMMSELGRETVSAYAAAKGGLKMLTRNIASEYGEYNIQCNGIGPGYIATPQTAPLRELQADGSRHPFDQFIIAKTPAARWGTPEDLQGPAVFLASDASDFVNGHVLYVDGGILAYIGKQPK

SEQ ID NO: 1834 - protein, 252 aa, Artificial Sequence
  Synthetic
MNRKIFVTGATSGIGLECARAFAKDGDHLLLAGRRADRLAAIKEDFEQQYGIRVDTLVLDVSKREDVDAKVKTAIEAFGGVDVLVNNAGLAQGLDPFQDSSVDDAVTMINTNVLGLLYVTKAVLPFMMAQNSGHIVNMGSTAGIYAYPGGAVYCATKAAVKMLADGIRMDTIATDIKVTTIQPGIVETPFSEVRFHGDAERAKSVYAGIEAVQPEDVADVVLYVTNQPKRMQISDVTIMANQQAAGFMVHKK

SEQ ID NO: 1835 - protein, 246 aa, Artificial Sequence
  Synthetic
MSENKVALITGATRGIGKEIALELAANGYDIAINYRSKQDGMEELKQEIEKKNVRCEFVKADVANFEECESMVNETVEKFGKIDVLVNNAGITRDGLLMRMKKEDFETVIDINLVGTFNVTRNVIPFMVKQRTGRIINLASVVGVVGNAGQTNYSASKAGIIGFTKSLAKEVASRNILVNAIAPGFIDTDMTKVLSDSVKEGIHAQIPLKRMGTTKEVAKVVKFLSSDDSSYITGQVINIDGGMVM

SEQ ID NO: 1836 - protein, 149 aa, Artificial Sequence
  Synthetic
MRHQGNGHIINISSVAAVAHIPFQTFYSASKAAISSYSYALENEVKPYGIHVTIVELGDICTGFTQMRQKSILGDDEYGGRISRSVSQMEHDEQNGMNPEVIGKYIANIVKKKKPAIVYVASTKYKFLSLLCKILPTAVREKIVEKVYG

SEQ ID NO: 1837 - protein, 264 aa, Artificial Sequence
  Synthetic
MVNFSLEGKVALVTGAAYGIGLAIAKALAGAGAKIAFNCKNPSTLERGIQAYKEAGIDAKAYLCDVTNEDDVKKMVADIEATIGSVDILVNNAGIIKRIPMHEMAVDEFRQVIDIDLIGPFICSKAVIPAMIKKGGGKIINICSMMSELGRETVSAYAAAKGGLKMLTRNIASEYGEYNIQCNGIGPGYIATEQTAPLRERQPDGSRHPFDSFIIAKTPAARWGTPEDLEGPALFLASSASDFVNGHILYVDGGILGYIGKQPK

SEQ ID NO: 1838 - protein, 252 aa, Artificial Sequence
  Synthetic
MQNYNPFSLRGKTILVTGASSGIGKATAVECARMGANLIVTARNEERLNATLAALDVESGQKHKAVIADLLVAEQMEKLIVESGKIDGLVLCSGKGLTLPFQFSSRDKFDDIFETNFYAPVELMRVLYKKKQINKEGSVVILASLGGTEVFSGGNCIYGASKAALNSVMKFCAKEFAPRKVRVNGICPGMVDTPLIHRGTVSEEQLQEDMKRYPLKRYGRPEDIAYNAVYLLSDASAWMTGHAMVLDGGMSI

SEQ ID NO: 1839 - protein, 246 aa, Artificial Sequence
  Synthetic
MDFTNKTVLVTGSSRGIGKAIAFAFGRAGARVVLNASRSKDQLAEAKKELEEMGVSCMAILADVSDYNACKDMFLQIQDAFGSIDILVNNAGISHIGLFTDMTPEQWQHVLNVNLGSVLNCTHLAIPAMVHNKKGVILNISSMWGEAGASCEAVYSASKGGINAFTKAMAKELGPSGIRVNAIACGVIDTEMNACFSEEERAELADEIALMRFGKPEEVGRFALTLASESASFLTGQIITLDGGML

SEQ ID NO: 1840 - protein, 148 aa, Artificial Sequence
  Synthetic
MRLLPVYFPHDLSSCCGRQELAQKAQEFILCTGNINDCRVLFLHNTGDVPSNACRVHAVLLVVLHLTDAPGDTSAVFIIAENAFLTCFCKSGADVTQFYDGNMDAVGLDFVCQRIGVRGNSGLACRVEGLERNVRYGSNRADVHNSGS

SEQ ID NO: 1841 - protein, 264 aa, Artificial Sequence
  Synthetic
MVNFSLEGKVALVTGASYGIGFALATAYAQAGAKIVFNDIKQELVDKGLAAYKAEGIDAKGYVCDVTNEEQVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASDASDFVNGHVLYVDGGILAYIGKQPK

SEQ ID NO: 1842 - protein, 252 aa, Artificial Sequence
  Synthetic
MLDFKDQVIIVTGAGSPKGIGRVIAKTFAKQGGTVIIADINQRGVDETVQIIQDEGGKAEGILLDVTSKESVENMVAQVMQNYGRIDVLINNAGISQKVTVAEMTLDDMKRIFNVNMFGLFLCTQACMKPMIEAGYGRIVNLSSVSAKRGGGIFGGAHYSASKAAVLAFSKNLSREICQYGITINCVCPGLINTEIWKSLPQEQAAKIIEGIPVGRPGETQEVADSIVFLASREASYITGEEIDINGGQHMD

SEQ ID NO: 1843 - protein, 246 aa, Artificial Sequence
  Synthetic
MATAIITGASQGIGACIAKRLAKDGFDIAVNHYPSENDKANAEKVAEECAEFGVKAVCFVADVSKYDQCEQMVKAVKAEFGTIDVLVNNAGITKDGLLARMSEENYDAVIAVNQKSVFNMMKTVCSVMMKQRSGRVINLSSVAGLYGNAGQFNYSASKAAVIGMTKTAAKEFGSRNITCNAVAPGFIQTPMTDALSDDQKKAILNMIAMKRYGQVDEIAGVVSFLASPDASYVTGQVIEISGGLSM

SEQ ID NO: 1844 - protein, 148 aa, Artificial Sequence
  Synthetic
MKKIFARFKRIDNRLRPLPYTELLKDSYSTGSVVGGSLKNKTILITGASSGIGLAMARRFLVEGCHVIISGRTESKLMSAISYLKQKGCDHVMYCLMDQMKDSELYALSQNIFKQFKVNVLINNAGFLKKKTGMEDSDLWKLKIIGQA

SEQ ID NO: 1845 - protein, 264 aa, Artificial Sequence
  Synthetic
MVNFSLEGKVALVTGASYGIGFAIATGFAQAGAKIVFNDIKQELVDKGLAAYKELGIDARGYVCDVTNEEAVNALVAQIEKEVGVIDILVNNAGIIKRIPMCEMSAAEFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGNPEDLMGPAIFLASDASNFVNGHVLYVDGGILAYIGKQPK

SEQ ID NO: 1846 - protein, 252 aa, Artificial Sequence
  Synthetic
MCNLKGKTAVITGGNSGVGAATAMLFAKEGANVVISARRQAALDEVAEKITAEGGNVITVSTDISKDEDCKALMDAAINKFGKIDILVNNAGVLDTGLAPVDKFDDDEIQKVISINQVGTMQCIRAALAHMSEGASIVNVASVAGVNGGGGAAYVSTKSAIIGITKHTALLLADKYIRCNAICPGTIVTPMTMNMKPENLDMRMMGAMNKHNDLKIKPCMAEDVANVIAFFASDNSKSLTGQIIVSDFGASL

SEQ ID NO: 1847 - protein, 246 aa, Artificial Sequence
  Synthetic
MNQKTAVVTGASRGIGKCIAITMAQNGYNVVVNYNSSYEKSKNVLDIVSEYSKGMMIKADISSVEEVKNMCKKIEQEFGTINVLVNNAGIIYRPGKWDVITDENWNMTYQVNAKGTFNCIRAMKPLFSMNETGHIINIASTVGEAGGAGVVSYGAAKAAVINMTKSFAKEFAPQIVVNAVSPGNINTDMTSGANDELVKKIIEKTPLRRLGEAQEVADLVVFLCSEKANFITGQIIDIDGGYSCRA

SEQ ID NO: 1848 - protein, 148 aa, Artificial Sequence
  Synthetic
VPDSRTRIVNISSVAAVAHIPFQTFYSASKAAVSSYSYALANEVKPYGIHVTVVELGDICTGFTKARQKSILGDDEYGGRISRSVSQMEHDEQNGMDPARIGRYIAGIVEKKKPAVVYVAGAQYKFLSLLCKLLPAAARGKIVGKIYG

SEQ ID NO: 1849 - protein, 264 aa, Artificial Sequence
  Synthetic
MVNFSLEGKVALVTGASYGIGFAIASAFAAAGATIVFNDIKQELVDKGLAAYKEKGIKAFGYICDVTNEEQVNALVAQVEKEVGVIDILVNNAGIIKRIPMCDMSAAEFRQVIDVDLNAPFIVSKAVIPGMIKKGHGKIINICSMMSELGRETVSAYAAAKGGLKMLTRNIASEYGEYNIQCNGIGPGYIATPQTAPLRELQADGSRHPFDQFIIAKTPAARWGTPEDLQGPAVFLASDASDFVNGHVLYVDGGILAYIGKQPK

SEQ ID NO: 1850 - protein, 252 aa, Artificial Sequence
  Synthetic
MKLQNKSVVVTGASSGMGKAIVELFVKEGAQVVAVARRRERLEELAKSLEGQPGQVVICQGDVSREEDNVRAIDLCVSTFGKLDILINNAGIMDDMAPIGACTNEKLHTVFDVNTFGPFYAMRKAVQTFQAQGQGGNIINVASVGAFHTAAGPIYCASKAALVALSKNTAFMYMPDHIRCNVIAPGGIVTEINQSMGMPNLAGYERVKLPLACSPELGSAEQIASAALFLASDDSSYVNGDVLMVDGGWNAM

SEQ ID NO: 1851 - protein, 246 aa, Artificial Sequence
  Synthetic
MLEGKTALVTGASRGIGREIALTLASYGADVIVNYNGSGEKADEVAAQIWEMGRKAEAMQCSVADYEACGEMITKALETFGKIDILVNNAGITRDNLLMRISPEDFDAVINTNLKGTYNTIKHLYRPFLKQRSGAIINMASVTGILGNAGQANYAASKAGVIGLTKSMARELASRNITVNAVAPGFIATDMTEAMTDAAKEATLQQIPLKRIGTPKDVAETVAFLASPKAAYITGQVISVDGGMAM

SEQ ID NO: 1852 - protein, 148 aa, Artificial Sequence
  Synthetic
MLTMLDTNVKGLMAVTRCFLPSMVAANQGHIINMGSTAGIYAYAGAAVYSATKAAVKTFSDGLRIDTIATDIKVTTIQPGIVETDFSAVRFHGDKERAATVYQGIEALQAQDIADTVVYVTSQPRRVQITDMTIMANQQATGFMVHKK

SEQ ID NO: 1853 - protein, 264 aa, Artificial Sequence
  Synthetic
MVNFSLEGKVALVTGASYGIGFALATAFARQGAKIVFNDIKQELVDKGLAAYKAEGIEAKGYVCDVTNEEQVNAMIAQIEKEVGVVDILVNNAGIIKRIPMVEMTAAEFRQVIDIDLNGPFIVSKAVIPSMIKKGHGKIINICSMMSELGRETVSAYAAAKGGLKMLTRNIASEYGEYNIQCNGIGPGYIATPQTAPLRERQADGSRHPFDSFIVAKTPAARWGTPEDLMGPAVFLASDASDFVNGHILYVDGGILAYIGKQPQ

SEQ ID NO: 1854 - protein, 252 aa, Artificial Sequence
  Synthetic
MDKIVFITGASSGIGAGCARKFASQGASLILNARNVDKLNGLKEELEKQYGVKVYLLPFDVRDRKAAMVALESLPEEWQPIDILVNNAGLVIGMDKEQEGSLDEWDIVIDTNIKALLAMTRLIVPGMVERKRGHIINIGSIAGDAAYPGGSVYCATKAAVKALSDGLRIDLVDTPLRVTNIKPGLVETNFSVIRFRGDKEKADNVYKGIRPLTGDDIAETVYFAASVPEYMQIAEMLVMPTYQATGTIVSRK

SEQ ID NO: 1855 - protein, 246 aa, Artificial Sequence
  Synthetic
MLTGKIAVVTGASRGIGKEIAKTLAAKGATVVVNYNGSAAKAEETVKEIEALGGKAEALQCNVSDYDKAAEMMAYVVKTYGRVDILVNNAGITRDNLLMKMSEEDFDAVLNTNLKGAFNCIKHISRQMLKQKSGHIVNISSVSGVMGNAGQVNYSASKAGIIGMTKAVAREMASRGITCNAVAPGFIKTDMTDVLSDTIKESINAQIPMRTFGETADVANLVAFLASDEAKYITGQVICVDGGMAI

SEQ ID NO: 1856 - protein, 145 aa, Artificial Sequence
  Synthetic
MKTVLITGASSGIGAGLARSFADDGYHIIACGRDPARLEALHQHSPNVTVRLFDMTDRDACRQALTGCYADVVILCAGTCEYLNFDMGPDYARTLAHLIGERLGAIEFLEPTFIVVSWMPTGSAGARWEAPRSPGGLLPFTPRSY

SEQ ID NO: 1857 - protein, 264 aa, Artificial Sequence
  Synthetic
MVNFSLEGKVALVTGASYGIGFAIATAFAKAGATIVFNDIKQELVDKGLAAYKEEGINAHGYVCDVTNEEAVNALVAQVEKEVGVIDILVNNAGIIKRIPMCEMSADQFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGTPEDLMGPAVFLASDASNFVNGHVLYVDGGILAYIGKQPK

SEQ ID NO: 1858 - protein, 252 aa, Artificial Sequence
  Synthetic
MRIIAITGATGGLAQEIVKQLPTDDFVIALGRNLKRLEACYANRPNTACYELDMTSDEAIGDMVEKLYANHGHIDVFINNAGYGDFSEFDAYTTAQIRDMFDINTFATMTFSRLVGHKMKEAGHGHIVNIASIAGLISSVKSSVYSATKFAVIGFSNALRLELADSNVYVTTINPGPIATTFFDKADPSGEYLKSVDKFVLQPDYVARRTVAILGKNKREVNMPFSMAAAHKFYTLFPKVADFLARKVFNYK

SEQ ID NO: 1859 - protein, 246 aa, Artificial Sequence
  Synthetic
MLQGKCAVITGASRGIGREIALQFAKEGANIVLNYRSSEEEALELKKELDKLGSNTLIIKADVSNFDEAENLIKEAKNTFGKVDILVNNAGITKDTLLIRMKEKDFDKVIEVNLKGAFNCLRAVTPIMIRQKEGKIINMSSVVGVVGNAGQVNYSASKAGVIGMTKSLAREIGSKNINVNAIAPGFIDTDMTRVLSEDQKKNIISGVPLKRLGQVEDIANLAVFLASDKSNYITGQVIHVDGGMAM

SEQ ID NO: 1860 - protein, 137 aa, Artificial Sequence
  Synthetic
MEQQMLKDKVAIITGASYGMGRTMAELFADEGAAVVITARHAEQLNEVVDGIRAKGEKAVGVVADVRSTEDTKKVFETAMKEFGDVDILINNAGIGEQKMIDETDDEWMMYVMNTNLGGPGPGHPGVQRCFPVSKRP

SEQ ID NO: 1861 - protein, 264 aa, Artificial Sequence
  Synthetic
MKSVKDKVVVITGATAGIGKATALYFAERGAKVVCLARRTVEGMDCISTDVTDKDAVNRAIEQISEKYGKIDVLVNNAGMGISGSIEDTDSVAAHKIFELNFFGALNVIQAVLPVMRAGVGGVIVNVSSVAAKLSIPFQAFYSATKAAVSSLSAALRAEVAPFNIKVTSVLPGDVKTDFTASREKNVSDNPVYGDRIRRSVATMERDEKNGMPPVVIAKDIYRLATMKNPPVTKTGGKKYALFVALAKFLPERAVNKLLAALYA

SEQ ID NO: 1862 - protein, 252 aa, Artificial Sequence
  Synthetic
MKLENKVAIVTGAGSGMGKAIAALFAKEGAKVIASDINEVGVKELISSSGDIAGEIVFSQTDVSNRSQVEAMIDLAVNKYGKLDVLVNNAGVLDQMYSVTEVEDEFWDKVIGVNVNSVMYACRKAIPIMIKNGGGSIINTASVGGLFGCRAGAAYTASKFAVVGLTKNIGFMYAKEGIRCNAICPGSIITNIAAGLSNASEFGMARSGAGVPLSPRMGQPEEIANTALFLASDESSFINGTTVTVDGGWTAY

SEQ ID NO: 1863 - protein, 246 aa, Artificial Sequence
  Synthetic
MINDKVAIVTGASRGIGAAIAKKLAGLGATVIVNYAGSKDKADMVVREIAEKGGRAIAKKCDISNYEMCQEFIKDVNDEFGSVDILVNNAGITKDGLCMAMKEEDFDAVINTNLKGTFNCIRFVSRIMVKQKAGKIINMASVSGVTGNAGQVNYSSAKAGVIGMTRSVAKELASRNINVNAVAPGFIKTDMTDKLSDKVKEEAVKQIPLGRFGRPEEVANLVAFLAGDDSDYITGQVFNIDGGMVM

SEQ ID NO: 1864 - protein, 134 aa, Artificial Sequence
  Synthetic
MKKVIIIGATSGIGRGLAERFIQEGNMVGITGRRENKLQELCSQNKNCFYTISDVTKETDTIRQLNNLVDRMGGMDILVFCSGVGELNPELDYNLERPTLLTNVIGFTNVADWAFYFCTNFLRRRLSVSGHIIR

SEQ ID NO: 1865 - protein, 264 aa, Artificial Sequence
  Synthetic
MGKLEGKVAVITGASKGIGEGIAKVYAKYGAKCVLAARGPKVLELAEELKKQGYEAVGVQTDVSDFESVKNLVKVAEETYGPVDILVNNAGICVLEDFLNDGSFENRDRHFDINIKGVWNTTKAVLPSMIKTGAGAIVIMSSVTGDMVADPGEVAYATSKAALVGFTKAMAREVADKQIRVNAICPGYVLTPLVEGMAKQSDPENPARAIQAIADAVPLGRLADPTEIGELAAFLGSEESSYITGAQIVIDGGSTLPETSSMGQ

SEQ ID NO: 1866 - protein, 251 aa, Artificial Sequence
  Synthetic
MSKKIIFITGVTSGVGRETARRFIKEGWKVIGTGRRQSRLDELAAELGGDFLPLCFDVAKRDVVVEMFANLPEGFKDIDVLLNNAGSSIGQNPAQSGNMDDWDEMIATNINGLLYCTRCVLPGMIERGTGHIVNIGSVAGNRAFKCGNVYGATKAFVNHFSRMLRCDLLGTPVRVTNIKPGHLHTEFLAVRFKGDLKTSEAAYENLDPLTPENIAESVWWSVNLPAHMDVCDMELMPMCQSDGGWGFCHKS

SEQ ID NO: 1867 - protein, 246 aa, Artificial Sequence
  Synthetic
MEDKKVALITGGTRGIGKAIAIKFAQNEYNLVLNYVSDRTNLEELKQEFKKYNIEVLFIKTDVSKFEECENMAKLAIEKFNKIDVLVNNAGITKDSLLLRMTPEDFEKVININLRGTFNVTKSIVPYMMKKRTGKIVNISSVVGVSGNAGQCNYAASKAGIIGFTKSIAKELASRNILANCVAPGFIDTDMTSVLSENVKESINAQIPLKRMGRSEEIANSVYFLAGEENTYITGQVLNVDGGMLM

SEQ ID NO: 1868 - protein, 124 aa, Artificial Sequence
  Synthetic
MGRFSGKKIVITGASSGIGLAGAMRIIDEGGEVMLTGRHQQKLASLRTLLPERAWFLQNDGAKPEAAHALAESVESFGMLDGLWLNAGQLAFSTVENTTETQFDTIMANNVRSQYVVDGGLLRL

SEQ ID NO: 1869 - protein, 264 aa, Artificial Sequence
  Synthetic
MVNFSLEGKTALVTGASYGIGFAIATAFAEAGATIVFNDIRQELVDKGLAAYREKGIRAHGYVCDVTDEEAVKAFIARVEQEVGTIDILVNNAGIIKRIPMCEMSAAEFRQVIDVDLNAPFIVSKAVIPGMIRKGHGKIINICSMMSELGRETVSAYAAAKGGLKMLTRNIASEYGEYNIQCNGIGPGYIATPQTAPLRERQADGSRHPFDAFIVAKTPAARWGTPEDLMGPAVFLASEASDFVNGHVLYVDGGILAYIGKQPK

SEQ ID NO: 1870 - protein, 251 aa, Artificial Sequence
  Synthetic
MENITGKVALVTGASQGLGRVIALELAKAGCRVIVNYANHSGNAEKVVAEIVAADGAAEPFRCDVSDEPAVRAMFAALEERFGGVDILVNNARIDPWRREASMSEGEWFDRVLSINLKGALLTSVAFMPKAMERRYGRIVNISSVRAFRAAEPNMIAYGVSKLGMHGLTRAFAEQGAPFNVTCNTVAPGMILTENIAKRLTPEKYAEECSAIPMRRGGTAEEIADAVLFPIRNGYVTGETININGGMYYAP

SEQ ID NO: 1871 - protein, 246 aa, Artificial Sequence
  Synthetic
MLKGRTAFITGTNRGIGKALVAEFARNGADVIAHARRKTPEFLSMLEEIASKYSVKVSPLFFDMTNSEAMKTAVRGLISSRIPVDILVNNAGVAHGGLFQMTGMSKVREVFDSNLFSMMELTQLLLRYMMRRRHASIINLGSVLGLDMPVGSCAYGLSKAAVMAFTRTLAAECGHLRIRVNAVAPGLVDTEMADQMESKAEEAMIAQCAMKRRAKPEEIAKMVVFLASEESSFVNGQIIRIDGGKV

SEQ ID NO: 1872 - protein, 121 aa, Artificial Sequence
  Synthetic
MKNYMDLTGRVAVVTGASSGIGYAYAKALAGNGAKVAAFARRLDKLNSLKEEIESLGGSCLPVACDVSDEEQVKAGVSKTIEHYGKIDILINNAGSIAVSPTDQLSLTDWQKVLVCCIVDI

SEQ ID NO: 1873 - protein, 264 aa, Artificial Sequence
  Synthetic
MVNFSLEGKVALVTGASYGIGLALATAFARAGAKIVFNDIKQELVDKGLAAYQAEGIEAKGYVCDVTNEEQVNAMVAQIEKEVGVIDILVNNAGIIKRIPMHEMTAAEFRQVIDIDLNGPFIVSKAVIPSMIKKGHGKIINICSMMSELGRETVSAYAAAKGGLKMLTKNIASEYGEFNIQCNGIGPGYIATPQTAPLREIQPDGSRHPFDSFIIAKTPAARWGTPEDLAGPAVFLASDASDFVNGHILYVDGGILAYIGKQPK

SEQ ID NO: 1874 - protein, 251 aa, Artificial Sequence
  Synthetic
MAALDFRGQTVWVTGAGKGIGYATALAFVEAGANVTGFDLAFDGESYPFATETLDVADADQVREACSRLLANTERLDVLVNAAGILRMGATDQLSAEDWQQTFAVNVGGAFNLFQQTMAQFRRQRGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASSHASHITLQDIVVDGGSTLGA

SEQ ID NO: 1875 - protein, 246 aa, Artificial Sequence
  Synthetic
MLSGKVAIVTGASRGIGRETALTLAGYGATVIVNYCGSKDKAEAVVEEIKAAGGNAKAYQGDVSDFDVAKEMITSVKKEFGSIDILVNNAGITKDNLIMRMSEEEFDKVIEVNLKGAFNCMKHVSRIMLKQKSGHIINMSSVSGVMGNAGQVNYCASKAGIIGMTKSAARELASRGVTVNAVAPGFIETEMTDVLPEDVKENLLASIPLKRMGQTKDIAETVAFLASDKAAYITGQTISVDGGMGM

SEQ ID NO: 1876 - protein, 121 aa, Artificial Sequence
  Synthetic
MERLKDKVIIVTGSTSGIGIGIAKLCAKEAATVVITGRNVERGQKVVDEITAEGGKAWFHAFDLTNTDSMHSLITDVAEKFGRIDVLINNAAGMGMKDGRVDELSVTRRIIVPTYGSFTAD

SEQ ID NO: 1877 - protein, 264 aa, Artificial Sequence
  Synthetic
MVNFSLEGKVALVTGASYGIGFAIATAFAQAGATIVFNDIKQELVDKGLAAYKEKGINAHGYVCDVTNEEAVNAFVAQVEKEVGVIDILVNNAGIIKRIPMCDMTAAQFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGTPEDLMGPAVFLASDASNFVNGHVLYVDGGILAYIGKQPK

SEQ ID NO: 1878 - protein, 251 aa, Artificial Sequence
  Synthetic
MRTILITGASGGLAQEMVKLLPEDRLILLGRNQEKLEKLYANHPQTECIEIDITDPSAVQQLVEKLYQRYGQIDVLVNNAGYGIFEDFDRISDQQVREMFEVNTFALMQLSRLIGAHMKAVGKGHIVNIVSMAGLVATAKSSLYSATKFAAIGFSNALRLELMPFGVHVTTVNPGPIRTTFFDQADPDGSYVKAVDRYILEPDFVAKKIVKNFGKPKRELNLPWLLNLTHKLYTLFPRISDKLASKMFNYK

SEQ ID NO: 1879 - protein, 246 aa, Artificial Sequence
  Synthetic
MDIKGKVALITGGGTGVGKGVALRLAKEGTNICVNYAHSEKEAYETKAEVEAFGVRCEVYKADVSVDEQCRAMVEAIIKDFGQLDILVNSAGRTHFVDHSDLEGMKSEYFDDIFDLNVKGTFFMCRAAADVLKKSHGVIINITSIAGVTGLGSSIAYAASKAAEISITKSLARVLAPEVRVIGVAPGIVLTRWVEGHAGHIDKLAGDTPLQKVAGPDDIAQTVYALIAHADFVTGQNLIVDGGAFI

SEQ ID NO: 1880 - protein, 120 aa, Artificial Sequence
  Synthetic
MSKVTVITGGTSGIGRGIVEKILANSAEDDLIFATYAHNAYKANEFWDNLKPEDQEKLIILKADMSSYDDMMNFVGEVKEKAGHVDWLISNAGISTYDKFQDYTDHLRMISSGKNQEKKW

SEQ ID NO: 1881 - protein, 264 aa, Artificial Sequence
  Synthetic
MVNFSLEGKIALVTGASYGIGFAIATAFAQAGATIVFNDIKQELVDKGLAAYKELGIEAHGYVCDVTDENAVNAFIAQVEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREPQPDGSRHPFDAFIVAKTPAARWGTPEDLMGPAVFLASDASNFVNGHVLYVDGGILAYIGKQPK

SEQ ID NO: 1882 - protein, 251 aa, Artificial Sequence
  Synthetic
MLTGKSLTGQVAIVTGASRGIGKAVAQTLAAEGATVIINYNGSAEAAEAVATDIRSHGGVAEAVKCNVADFAESEAFVKAVTEKYGRVDILVNNAGITRDNLIVRMTEEEFNAVMDTNLKGAFHMIKHLGRTFMKQRYGKIINISSVSGIVGNAGQANYSASKAGLIGLTKSVARELASRNICVNAVAPGFIRTDMTDKLPEAVQDNAVGQIPLKKMGRPEDVAQAVLFLAGNASDYITGQVLCVDGGMAM

SEQ ID NO: 1883 - protein, 246 aa, Artificial Sequence
  Synthetic
MEKLLGKTALITGASRGIGRAIAIEFAKEGANIVINYSKDELGAEETLKILKGIGVVAYKIKEDVSSFKGAEKIIDFTLKSFGKIDILVNNAAKSTIGLFMDSSKEEIENILNTNLLGPLYLSKMAIPHMINKNGVILNISSMWGEVGASCEVLYSTSKGGINLFTKALAKEMAPSNIRVNAIAPGVIDTSMNSFLSKEDRKDLEEEIPFGRFGSPEEIGKIAVFLCSKDSSYITGQIIRADGGYI

SEQ ID NO: 1884 - protein, 119 aa, Artificial Sequence
  Synthetic
MKNTAFVTGATSGFGEEIARELSAQGYKIVALGRRRERLEKLALELGDTHIVAADVRDKDAIFDAVKNLPENFRDVEVLVNNAGLALGLDGFADTDVKNLEIMVDTNIKSGLFVDKKNG

SEQ ID NO: 1885 - protein, 264 aa, Artificial Sequence
  Synthetic
MVNFSLEGKVALVTGASYGIGFALATAYAQAGAKIVFNDIKQELVDKGIAAYKAEGIDAKGYVCDVTNEEQVNAMVAQIEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREPQADGSRHPFDAFIVAKTPAARWGTPEDLMGPAVFLASDASDFVNGHVLYVDGGILAYIGKQPK

SEQ ID NO: 1886 - protein, 251 aa, Artificial Sequence
  Synthetic
MNGLDFHGRTVWITGAGKGIGYATALAFVEAGAQVTGFDLAFDGESYPFATETLDVADAQQVAQTCGRLLAGIARLDVLVNAAGILRMGATDALSQEDWQQTFAVNVGGAFNLFQQTMAQFRRQKGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASDHASHITLQDIVVDGGSTLGA

SEQ ID NO: 1887 - protein, 246 aa, Artificial Sequence
  Synthetic
MFEGKTAVVTGAGKGLGQAMAVALACEGANLIGVDIGDMAETSRTILECGGKFTAVTADLSKTDQIPALAEKMEDIYGQIDILVNNAGVIYRSPAEEYPEDGFDFVMNLNVKALFLLTREIGSRMKNRGWGRIINVCSIQSMQGGNGVSAYAASKHAVAGITRAFANEWGKYGVTVNGIAPGYMVTDNTDKLRAQKEKAASITNRIPVGRWGQPSDLMGPVVFLASDGAAYVNGHLLVVDGGYMNT

SEQ ID NO: 1888 - protein, 118 aa, Artificial Sequence
  Synthetic
MVTYNVNLEGKTVLVTGAAGFIGSNLVKRLFKDINSIKVIGIDSITDYYDVNIKYERLKEIEALGCDWQFYQTSIADRTSLENIFTENKISVVVNLAAQAGVRSSGGVDSRGCATCGL

SEQ ID NO: 1889 - protein, 264 aa, Artificial Sequence
  Synthetic
MVNFSLEGKIALVTGASYGIGFAIATGFAQAGATIVFNDIKQELVDKGLAAYKELGINAHGYVCDVTDEKAVNAFIAQIEKEIGVIDILVNNAGIIKRIPMCDMTAAEFRQVIDVDLNAPFIVSKAVIPGMIKKGHGKIINICSMMSELGRETVSAYAAAKGGLKMLTRNIASEYGEYNIQCNGIGPGYIATPQTAPLREPQPDGSRHPFDAFIVAKTPAARWGTPEDLMGPAVFLASDASNFVNGHVLYVDGGILAYIGKQPK

SEQ ID NO: 1890 - protein, 251 aa, Artificial Sequence
  Synthetic
MIGYGMEKKKGVISGGTSGIGLAAARLLVQDGATVWLVGRDPERGQKAVESLIGLPGEALYLQGDVSTVEGCRKIAGELQAQHQELDFLVNSAGIYQEKPFQDVTEEDYQQLMDVNVKGTIFLTQALLDLFVQDGPSIVNIASDAALEGNYGCCLYAASKGAVVAFTRSLALDLAPWIRVNCLCPGDVDTPLVEKQLAEGGYSRESMASVYPLGRIGKPEEAAHMICAVLSPMNGFMTGAVVPVDGGLTAK

SEQ ID NO: 1891 - protein, 246 aa, Artificial Sequence
  Synthetic
MSENKVALITGATRGIGKEIALELAANGFDIAVNYRSMQDGMEKLKKEIESNNVKCEFVQADVADFEQCEKMVKETIEKFGKIDVLVNNAGITKDGLIMRMKKEDFQAVIDINLTGTFNVTRNVIPYMIKQKSGRIINLSSVVGVAGNAGQTNYSASKAGVIGFTKSLAKEVASRNILVNAIAPGFIDTDMTKVLSDNVKEGINAQIPLRRMGTPNEVAKVVKFLSSDDSSYITGQVINIDGGMVM

SEQ ID NO: 1892 - protein, 116 aa, Artificial Sequence
  Synthetic
MMEAAMRLGLEGKTVVITGGAGGIGKEAARGFLKEGAAVAVFARTEEKVDDFCREMRGLGYDNFYGEVLEKLTNSILLFFIQKVEIIHNIFQILQIGKEFICIYKIFVYIVKVADK

SEQ ID NO: 1893 - protein, 264 aa, Artificial Sequence
  Synthetic
MVDFSLEGRVALVTGASYGIGFAIAVGFAQAGAEIVFNDIKQELVDKGIAAYKELGINAHGYVCDVTNEEAVNALVAKVEKEVGVIDILVNNAGIIKRIPMHEMSAAEFRQVIDVDLNAPFIVSKAVIPSMIKKGHGKIINICSMMSELGRETVSAYAAAKGGLKMLTRNIASEYGEYNIQCNGIGPGYIATPQTAPLREKQPDGSRHPFDAFIVAKTPAARWGTPEDLMGPAVFLASDASNFVNGHVLYVDGGILAYIGKQPK

SEQ ID NO: 1894 - protein, 251 aa, Artificial Sequence
  Synthetic
MESLQNKIVFVTGGANGIGRSIVKAFCEEGADVTFCDMDEEAGKRLSEEMKSYKCSFAQLDVSEAGALSDLIHTIISKKGNIDIIINNVGVSNFGSILDVSVEDFDKVLNINLRPIFILAKLLAKHRSLNKELNTYGRIINMASTRYLMSEPNSEAYAASKGAIVSLTHALAISLSEYNITVNCISPGWIDTGHYGDLRPEDHKQHPSGRVGKPEDIARACLFLCDPANDFINGQNIVVDGGMTKKMIYIE

SEQ ID NO: 1895 - protein, 246 aa, Artificial Sequence
  Synthetic
MLEQKVAVVTGASRGIGKAIAKRLAKDGIFVVINYRGNEAQAKQVLKEIEEEHGKAAICACDVSDFSACEEFIKDVIQTYGRLDILVNNAGITRDGLLMKMSEEDYDTVLQTNLKGTFNGIRFASRQMLRQKQGRIISISSVSGVLGNAGQANYCASKAGVIGLTKAAARELASRGVTVNAVAPGFIKTEMTDVLSEQVQENAKAQIPLGSFGEPEDVAEAVAFLSSEQARYITGQVLCVDGGMAM

SEQ ID NO: 1896 - protein, 115 aa, Artificial Sequence
  Synthetic
MEKKTVLITGASSGIGEGCARKFAMNGHRLILNGRNVEKLNAVKDELEEKYGVEVWLLPFDVRDRAAARAALDSLPEEWKAIDVLVNNAGLVIGVDKEHYVRRYQHRVGYRGIYP

SEQ ID NO: 1897 - protein, 264 aa, Artificial Sequence
  Synthetic
MVNFSLEGKVALVTGASYGIGFALATAFARQGAKIVFNDIKQELVDKGLAAYKAEGIEAKGYVCDVTSEEQVNAMVAQIEKEVGIVDILVNNAGIIKRIPMVEMTAAEFRQVIDIDLNGPFIVSKAVIPSMIKKGKGKIINICSMMSELGRETVSAYAAAKGGLKMLTRNIASEYGEYNIQCNGIGPGYIATPQTAPLRERQADGSRHPFDSFIVAKTPAARWGTPEDLMGPAVFLASDASDFVNGHILYVDGGILAYIGKQPQ

SEQ ID NO: 1898 - protein, 251 aa, Artificial Sequence
  Synthetic
MAGFDFAGKTVWVTGAGKGIGYTTALAFANAGAEVTGFDREFPQDNYPFATEVLDVANTGQVAEVCQRVLKARERLDVLVNAAGILRMGATDALSVEEWQQTFAVNVGGAFNLFQQTMAQFRRQQGGAIVTVASDAAHTPRIGMSAYGASKAALKSLALTVGLELAGSGVRCNVVSPGSTDTDMQRTLWVSDDAEQQRIRGFGEQFKLGIPLGKIARPQEITNTILFLASDLASHITLQDIVVDGGSTLGA

SEQ ID NO: 1899 - protein, 246 aa, Artificial Sequence
  Synthetic
MKRTVLITGASRGIGRAIAECFAEHGYQVGINYCSSHREAIGLKQDLCEKYGEEAAELFQGDVSKEEEVRRIGKEISDRFGGIDVLINNAGVAQQKLLTQTTMEDWDTLFRINARGTFLCSREFLPRMIQKHKGKIINISSMWGITGASCEVAYSASKAAVIGFTKALAKEVGPSHINVNCIAPGVIQTQMNDALGEETLNALREETPLEMLGTGMDVAQLALFLASEKADFITGQVISVDGGMVI

SEQ ID NO: 1900 - protein, 114 aa, Artificial Sequence
  Synthetic
MGLLDGKTAIVTGAARGIGKAIALKFAQEGANIAFTDLVIDENAEATAKEIETLGVKAKAYASNAASFEDTAKVVEAIHADFGRIDILVNNAGITRDGLSKSCHQCILLGFYSI

SEQ ID NO: 1901 - protein, 264 aa, Artificial Sequence
  Synthetic
MMRKTAIVTGGSRGIGFGIALELAKHGYNIAILDVNDLEDPSRPDYKENMAKLEAAGAEYLYQKGDTRTAADRESFVKAVVERFGEIDVLVNNAGVAPKIRLDMLETTEESFDFVVGTVLKGTMFMTQLVANQMLKQPWDPEKEPKRGTIINIGSASATVSSTNRVEYCVAKSGLMMLTTCYADRLAAEGIMVHELRPGVIDTDMTKVVHEKYTRLIAEGQFPIARWGTPEDLGKVARLVCDDDFVYTTGNYIDVDGGFHIRRL

SEQ ID NO: 1902 - protein, 251 aa, Artificial Sequence
  Synthetic
MAALDFHGQTVWVTGAGKGIGYATALAFVEAGANVTGFDLAFAGAGYPFATETLDVADADQVRDVCARLLNNIERLDVLVNAAGILRMGATDQLSAEDWQQTFAVNVGGAFNLFQQTMAQFRRQRGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASSHASHITLQDIVVDGGSTLGA

SEQ ID NO: 1903 - protein, 246 aa, Artificial Sequence
  Synthetic
MSENKVALITGATRGIGREIALELAENGMDIAINYRSESDIPEDLKGEIEAYNVRCEFVQADVSDFGQCERMVKETIEKFGKIDVLVNNAGITRDGLIMRMKKEDFESVIDVNLVGTFNVTRNVIPHMIKQRAGRIVNLASVVGVAGNAGQTNYSASKAGVIGFTKSLAKEVASRNILVNAVAPGFIDTDMTSVLSDSVKENIHAQIPLKRMGTKREVAKVVKFLVSEDSSYVTGQVVNIDGGMVM

SEQ ID NO: 1904 - protein, 112 aa, Artificial Sequence
  Synthetic
MIDMERFLENKVCIITGAAQGIGKSIAERFASDGALVYACDRAEGVMDEWAKACSEKYGTRVCPLYFDVTDAVAVKSAFMSVFKQERRIDVLVNNAGVVFNKKIGMILRPET

SEQ ID NO: 1905 - protein, 264 aa, Artificial Sequence
  Synthetic
MVNFSLEGKVALVTGAAYGIGLAIAQAFAEAGAKIVFNCSRQETVDRGLKAYKELGIDAKGYLCDVTDEEAVKAMVADIEATVGTIDILVNNAGIIKRIPMEEMNVEDFRRVVDVDLVAPYICAKAVIPGMIKKGHGKIINICSMMSELGRETVSAYAAAKGGLKMLTRNICSEYGEHNIQCNGIGPGYIATEQTAPLRERQADGSRHPFDQFIISKTPAARWGTPEDLMGPAVFLASDASDFVNGHVLYVDGGILAYIGKQPK

SEQ ID NO: 1906 - protein, 251 aa, Artificial Sequence
  Synthetic
MDRLKGKVAVITGANSGVGEATALAFAKEGATVVISARRIEPLNAVADKIKAEGGTVLAVPTDISDKAACENLMDKAVEAFGKIDILVNNAGVLESGLKPIDRFNDDDLDRIINTNEKGTMYCMRAALKYMKEWASIVNVASVAGVMGCGGAAYVASKAAIVGITKHTAMRYADKHIRCNAVCPGNILTPMTANASNDLDVDMITAMSKHNDLRVGSCTAEQVAGIILFMASDEAKPINGQILVSDFGSTL

SEQ ID NO: 1907 - protein, 246 aa, Artificial Sequence
  Synthetic
MDKKVAFITGGSRGIGKEIAKKFAKNGYNLVINYVSEKTDVVKLGSELNQNGSVEVLCVKGDVTDFAICEEMVKKAVEKFGKIDVLINNAGITKDNLLMRMKEEDFDKVINVNLKGTFNMTKNVISYMMKQRNGKIVNISSVVGVSGNSGQANYAASKAGVIGFTKSVAKELASRNILANAVAPGFIETDMTDVLSDSVKESIHAQIPLKKMGKAEEVANAVYFLGSEENTYITGQVLNVDGGMIM

SEQ ID NO: 1908 - protein, 109 aa, Artificial Sequence
  Synthetic
MSHDTTRAVCFIHMSGISLVGKIACITGASRGIGEGIAKALAKEGCKLGICSRKEADIERCKREIEKMGADVFAMPVDVTSKEEVSFCFPCDVLDAGLYRWSDEALWED

SEQ ID NO: 1909 - protein, 264 aa, Artificial Sequence
  Synthetic
MVNFSLEGKVALVTGASYGIGFAIATGFAQAGAKIVFNDIKQELVDKGLAAYKELGIDARGYVCDVTDEKAVNALVAQIEKEVGVIDILVNNAGIIKRIPMCEMSAAEFRQVIDVDLNAPFIVSKAVIPSMIKKGHGKIINICSMMSELGRETVSAYAAAKGGLKMLTRNIASEYGEFNIQCNGIGPGYIATPQTAPLRERQADGSRHPFDAFIVAKTPAARWGNPEDLMGPAIFLASDASNFVNGHVLYVDGGILAYIGKQPK

SEQ ID NO: 1910 - protein, 251 aa, Artificial Sequence
  Synthetic
MSKIALVTGASAGFGKAIVEKLVSDGYRVIASARRLEKLRSLQVALGEQNVYPLQMDVSQTQVIDEALASLPKEWREIDILVNNAGLALGLDKAYEADFSDWLTMINTNIVGLTYLTRQILPDMVKRNTGMIINLGSTAGTVPYPGANVYGASKAFVKQFSLNLRADLAGTKIRVTNIEPGLCEGTEFSNVRFKGDDERAEKLYDGAHAIKPENIANTVSWVASQPSHVNINRIEIMPVSQSFGPQPVYRD

SEQ ID NO: 1911 - protein, 246 aa, Artificial Sequence
  Synthetic
MLEGKVAVVTGASRGIGKAIAKKLALQGAKVIINYNGSEEKALAVKAEIEEAGGQAVVYQCNVADYAACETFIQTVIKEQGSLDILVNNAGITRDGLLMKMSEEDFDQVVNTNLKGAFHTMRFAARQMLKQRSGRIINMSSVVGVSGNAGQVNYAASKAGVIGMTKSAARELASRGVTVNAVAPGFISTDMTDVLSDKVKEAAEGQIPLGRFGKPEDVAAAVAFLASEEAGYITGQVLHVDGGMCM

SEQ ID NO: 1912 - protein, 106 aa, Artificial Sequence
  Synthetic
MILQGKTALISGGSRGIGRAIAELYYKEGAKLFIMSRNKEQLEQAAKEIDCNNENRVFAIPCDVGDKESVDKAFEQIKALGGSIDILVNCAGVNLRGPLETMPLET

SEQ ID NO: 1913 - protein, 264 aa, Artificial Sequence
  Synthetic
LDKLKDKVVVITGATAGIGRAAAQLFKAKGARVVCIARRKSDEFYSVSADVTDEAAVLAAVSEIKEKFGRIDVLVNNAGMGISGAVEDTDLADAKRIFDVNFFGALNTIKAVVPVMRGCGGGTIINLSSVAAELAIPFQAFYSATKAALSSMSGSLRNEVAPFGIKVSCVLPGDVKTDFTSSRKKNVKNTPEYGERIKRAVAAMERDEENGLPPSLIAKKIVKLARAKNPPVAVSGGAKYAVFLFLNRILPKRLVSFILGKMYG

SEQ ID NO: 1914 - protein, 251 aa, Artificial Sequence
  Synthetic
MRTILITGASGGLAQEMVKLLPEDRLILLGRNQEKLEKLYASHPQAECIGIDITDSSVVKDLIEELYQRYGQIDILVNNAGYGIFEAFDRISDQQVQEMFEVNTFALMQLSRSIGTHMKEAGKGHIVNIVSMAGLVATAKSSLYSATKFAAIGFSNALRLELMPFGVHVTTVNPGPIRTTFFDQADPDGSYVKAVDRYILEPDFVAKKIVKNFGKAKRELNLPWLLNLTHKLYTLFPRISDKLASKMFNFK

SEQ ID NO: 1915 - protein, 246 aa, Artificial Sequence
  Synthetic
MLKDKVAIVTGASRGIGREIAITLAKYGAKVVVNYCGSKEKAEEVVELIKAEGGIASVYQGDVADSEAMKQMFADVLKEYGSIDILVNNAGITRDNLILKMSDEEFNDVIDTNLKGVYYCLKQVSKIMLKQRSGRIINISSIAGVIGNAGQINYSASKAGVIGMTKALARELGSRGITVNAVAPGFIKTDMTDKLPDALKDTYVNQIPLKRFGEVSDIAETVAFLASDKAAYITGQTISVDGGMQM

SEQ ID NO: 1916 - protein, 103 aa, Artificial Sequence
  Synthetic
MEKMRFEGKVVIVTGASSGIGRSTARLFAMEGAKVVAAARRLKRLEDLRDKVAAENAPGVILPVKTDVRDPAQIEAMFDTCLKEFGHLDILVNNAGVHNLSAV

SEQ ID NO: 1917 - protein, 264 aa, Artificial Sequence
  Synthetic
MVNFSLEGKVALVTGASYGIGFAIATAFAEAGARIAFNDIKQELVDKGLASYKEKGIEAKGYVCDVTKEDQVTDLVKKIENDLGPVNILVNNAGIIKRIPMCEMKAEEFRQVIDVDLNAPFIVSKAVIPSMIAQGGGKIINICSMMSELGRETVSAYAAAKGGLKMLTRNIASEYGEYNIQCNGIGPGYIATPQTAPLRERQPDGSRHPFDAFIVAKTPAARWGTTDDLKGPAVFLASEASDFVNGHVLYVDGGILAYIGKQPQ

SEQ ID NO: 1918 - protein, 251 aa, Artificial Sequence
  Synthetic
MAALDFRGQTVWVTGAGKGIGYATALAFVEAGANVTGFDLAFDGERYPFATETLDVADADRVREVCSRLLANTERLDVLVNAAGILRMGATDQLSAEDWRQTFAVNVGGAFNLFQQTMAQFRRQRGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASSHASHITLQDIVVDGGSTLGA

SEQ ID NO: 1919 - protein, 246 aa, Artificial Sequence
  Synthetic
MLENKVALVTGASRGIGRAIAERLAKDGATVIVNYNGSRDKAEAVVKEIEEAGGKAEAYQCSVADFAGVEEMMSYVIKTYGRIDILVNNAGITRDGLLMKMSEEDFDAVIATNLKGTFNCMRHVARQMIKQRGGRIINISSISGVMGNAGQMNYAASKAGVIGMTKTAARELASRGITVNAIAPGFITTDMTDVLSDSVKESLLAQIPMKAMGEPADIAGTAAFLASDDAKYITGQVINVNGGMAM

SEQ ID NO: 1920 - protein, 101 aa, Artificial Sequence
  Synthetic
MFDYTGKIVVVSGASSGLGRQMALGYARQGASVVITARRMEKLEAVADEIRALGAEAYPIKCDVTDVESVNAAAKEVKEKYGKVDVLVNCAGSAKNAGVLD

SEQ ID NO: 1921 - protein, 264 aa, Artificial Sequence
  Synthetic
MVNFSLEGKVALVTGASYGIGFALATAFARQGAKIVFNDIKQELVDKGLAAYKAEGIEAKGYVCDVTNEEQVNAMVAQIEKEVGVVDILVNNAGIIKRIPMVEMTAAEFRQVIDVDLNAPFIVSKAVIPSMIKKGHGKIINICSMMSELGRETVSAYAAAKGGLKMLTRNIASEYGEYNIQCNGIGPGYIATPQTAPLRERQADGSRHPFDSFIVAKTPAARWGTPEDLMGPAVFLASDASDFVNGHVLYVDGGILAYIGKQPQ

SEQ ID NO: 1922 - protein, 251 aa, Artificial Sequence
  Synthetic
MAALDFRGQTVWVTGAGKGIGYATALAFVEAGANVTGFDLAFAGEGYPFATETLDVADADQVRDVCVRLLNDIERLDVLVNAAGILRMGATDQLSAEDWQQTFAVNVGGAFNLFQQTMAQFRRQRGGAIVTVASDAAHTPRIGMSAYGASKAALKSLALTVGLELAGSGVRCNLVSPGSTDTDMQRTLWVNDDAEQQRIRGFGEQFKLGIPLGKIARPQEIANTILFLASSHASHITLQDIVVDGGSTLGA

SEQ ID NO: 1923 - protein, 246 aa, Artificial Sequence
  Synthetic
LKKTVLITGGSRGIGKETSIEFAKNGYNVVINYESDEKSALSLKEELEEKYSSDVMICMCDVSNEISVQKMVDDIINYYGRIDVLINNAGISNDTLLEDKKISDFKRVLDVNLVGPFILSREVGKLMLKNKSGVIINVSSTNAIDTYYEYSIDYDASKAALISLTHNLSKYLAPYIRVNAVAPGWVNTDMNKNLDEDYIKEEIKDIYLKRFAEAKEIAKVIYFLASDDASYITNEVIRVDGGYNHG

SEQ ID NO: 1924 - protein, 99 aa, Artificial Sequence
  Synthetic
MFDLAGRVAVVTGASAGLGRGEAIALARQGADVAILARRADKLEGVAEEIRAFGHKCLPIVCDVTDLDQIKAAVKQVMETFGKVDILVNNTGGGDTMRP

SEQ ID NO: 1925 - protein, 264 aa, Artificial Sequence
  Synthetic
MKEFTPESFRLDGKIALVTGASYGIGFAIASGFAKSGATIVFNDINQELVDKGLKAYEEAGIQAHGYVCDVTDENAVQELVKKIEEEVGVIDILVNNAGIIKRIPMIEMSADDFRKVVDIDLNGPFIVSKAVIPSMIKKGHGKIINICSMMSELGRETVSAYAAAKGGLKMLTRNIASEYGEYNIQCNGIGPGYIETPQTAPLRTEGHPFNSFIISKTPAARWGTTEDLMGPAVFLASDASNFVNGHILYVDGGILAYIGKQPQ

SEQ ID NO: 1926 - protein, 251 aa, Artificial Sequence
  Synthetic
MRTILITGASGGLAQEMVKLLPEDRLILLGRNQEKLEKLYASHPQAECIGIDITDSSAVQDLVEELYQRYGQIDILVNNAGYGIFEEFDQITNEQIHAMFEVNTFALMQFSRLMGANMKEAGKGHIVNIVSMAGLVATAKSSLYSATKFAAIGFSNALRLELMPFGVHVTTVNPGPIRTTFFDQADPDGSYVKAVDRYIFEPDFVAKKIVKNFGKAKRELNLPWLLNLTHKLYTLFPRISDKLASKMFNFK

SEQ ID NO: 1927 - protein, 246 aa, Artificial Sequence
  Synthetic
MQDKQKIAIVTGASRGIGREVAKELAESGITVIANYNKSEEEAKKLQQELEEQNFKLEIFKADVSKREDVKKLVEYTIEKYGKIDILINNAGISEYKLFTDETDEDWDKLINTNLYSAFAMSQEVIPNMVHNKKGCIINISSIWGIVGGSLEVLYSISKAGLDGMTKALAKELGPSNIRVNSIAPGMINTKMNSKFTEKEIEEIKEEIPLERLGDPQDIAKCVKWLIDDNYTTGQVISINGGWVIT

SEQ ID NO: 1928 - protein, 95 aa, Artificial Sequence
  Synthetic
MVQYNVNLEGKTVLVTGAAGFIGSNLVKRLFKDIKNIKVIGIDSITDYYDVNIKYERLKEIEALNRDWEFGDAKLLQKSEMRKDIVIELSYKGFS

SEQ ID NO: 1929 - protein, 93 aa, Artificial Sequence
  Synthetic
MTNKTALITGATGGLGKEFVRIHAQNGGDLILVGRNPQKLEQLQHEVQNKYHVKATTIAVDFTEFDATEQIFAELQKANIQVDYLINNASLGD

SEQ ID NO: 1930 - protein, 90 aa, Artificial Sequence
  Synthetic
MEKKIVLITGASSGIGEGCARKFAMNGYRLILNGRNVEKLNAVKKELLEKYGADVYLLPFDVRDRQAARAALESLPEEWKAVDTAKSVQF

What is claimed is:

1. A non-naturally occurring microbe engineered to express one or more cholesterol oxidoreductase (COR) proteins or a homolog thereof, wherein the one or more COR proteins or homologs thereof is selected from one or more sequences in Table 1 or Table 2.

2. The microbe of claim 1, wherein the one or more COR proteins or homologs thereof originate from the phylum Firmicutes.

3. The microbe of claim 2, wherein the one or more COR proteins or homologs thereof originate from the neighborhood or marker species of Cluster IV *Clostridium* group or Cluster XIVa *Clostridium* group.

4. The microbe of claim 1, wherein the microbe is engineered to express one or more heterologous COR proteins or homolog thereof.

5. The microbe of claim 1, wherein the one or more COR proteins or homologs hereof is from *Eubacterium coprostanoligenes*.

6. The microbe of claim 1, wherein the one or more COR proteins or homologs thereof has at least 50% amino acid identity with ECOP170 (SEQ ID NO: 44).

7. The microbe of claim 1, wherein the one or more COR homologs comprise amino acids corresponding to S138, Y151, and/or K155 of ECOP170 (SEQ ID NO: 44).

8. The microbe of claim 1, wherein the one or more COR proteins or homologs thereof originate from a human.

9. The microbe of claim 1, wherein the one or more COR proteins or homologs comprise a sequence selected from SEQ ID NOs: 1-40, or SEQ ID NO: 44.

10. The microbe of claim 1, wherein the one or more COR proteins or homologs thereof originate from a human, optionally selected from the Metagenomic Species (MSP) MSP_0701 (SEQ ID NO: 9), MSP_0759 (SEQ ID NO: 8), MSP_0654 (SEQ ID NO: 7), MSP_0205 (SEQ ID NO: 13), MSP_0421 (SEQ ID NO: 14), MSP_0764 (SEQ ID NO: 11), MSP_0238 (SEQ ID NO: 16), MSP_0522 (SEQ ID NO: 24, 25), MSP_0672 (SEQ ID NO: 21), MSP_0602 (SEQ ID NO: 23), MSP_0645 (SEQ ID NO: 19), MSP_0476 (SEQ ID NO: 18), MSP_0640 (SEQ ID NO: 17), MSP_0676 (SEQ ID NO: 5), MSP_0638 (SEQ ID NO: 6), MSP_0562 (SEQ ID NO: 4), MSP_0196 (SEQ ID NO: 3), MSP_0832 (SEQ ID NO:26) and MSP_0741 (SEQ ID NO: 2).

11. The microbe of claim 1, wherein the one or more COR proteins or homologs thereof are selected from the group consisting of ECOP170, CAG:180, CAG:251, CAG:341, CAG:217, CAG:528, and CAG678.

12. The microbe of claim 1 further engineered to express a cholesterol transporter.

13. The microbe of claim 1, wherein the engineered microbe is an engineered variant in the genus or family or phylum of a *Corynebacterium, Bifidobacterium, Atopobium, Faecalibacterium, Clostridium, Roseburia, Ruminococcus, Dialister, Lactobacillus, Enterococcus, Staphylococcus, Streptococcus, Sphingobacterium, Bacteroides, Tannerella, Parabacteroides, Alistipes, Prevotella, Escherichia, Shigella, Desulfovibrio, Bilophila, Helicobacter, Fusobacterium, Pediococcus, Bacillus, Leuconostoc, Akkermansia, Methanobrevibacter, Propionibacterium, Coriobacteriaceae, Actinobacteria, Rikenellaceae, Lachnospiraceae, Firmicutes, Peptostreptococcaceae, Veillonella, Oscillospira, Slackia, Eggerthella, Gordonibacter, Geobacter, Alkaliphilus, Cantenibacterium, Holdemania, Marvinbryantia, Symbiobacterium, Rysipelotrichaceae, Butyricicoccus, Sporobacter, Blautia, Dorea, Succinivibrio, Barnesiella, Biolophila, Eubacterium,* or *Saccharomyces* microbe.

14. The microbe of claim 13, wherein the microbe is *E. coli*.

15. A composition comprising the microbe of claim 13.

16. The composition of claim 15, wherein the composition is formulated for oral delivery.

17. A probiotic composition comprising one or more microbes according to claim 1.

18. The probiotic composition of claim 17, wherein the one or more COR proteins or homologs thereof originate from the neighborhood or marker species of Cluster IV *Clostridium* group or Cluster XIVa *Clostridium* group.

19. The probiotic composition of claim 17, wherein the one or more microbes are selected from the Metagenomic Species (MSP) MSP_0701, MSP_0759, MSP_0654, MSP_0205, MSP_0421, MSP_0764, MSP_0238, MSP_0522, MSP_0672, MSP_0602, MSP_0645, MSP_0476, MSP_0640, MSP_0676, MSP_0638, MSP_0562, MSP_0196, MSP_0741, MSP_0910, MSP_832, Obregon-TitoAJ_2015_NO16 bin.9, UMGS233, UMGS598, UMGS135, GeversD_2014_SKBSTL024_bin.4, UMGS98, LeChatelierE_2013_MH0448_bin.22, SmitsSA_2017_TZ_65172_bin.2, XieH_2016_YSZC12003_36049_bin.90, LoombaR_2017_SID5447_cka_bin.41, VincentC_2016_MM029.3_bin.33, UMGS234, UMGS1867, ZellerG_2014_CCIS11015875ST-4-0_bin.2, or combinations thereof.

20. The probiotic composition of claim 17, wherein the probiotic composition is formulated for oral administration and is, optionally, a powder, bolus, gel, capsule, liquid, or foodstuff.

21. The probiotic composition of claim 17, further comprising one or more prebiotics.

22. A method of reducing serum total cholesterol and/or triglycerides in a subject in need thereof comprising administering to the subject a therapeutically effective amount of the engineered microbe of claim 1 to the subject.

23. The method of claim 22, wherein the subject has hypercholesterolemia.

24. The method of claim 22, further comprising delivering coprostanol, cholestanone, or coprostanone.

* * * * *

UNITED STATES PATENT AND TRADEMARK OFFICE
CERTIFICATE OF CORRECTION

PATENT NO. : 11,633,436 B2
APPLICATION NO. : 17/026109
DATED : April 25, 2023
INVENTOR(S) : Douglas Kenny et al.

Page 1 of 3

It is certified that error appears in the above-identified patent and that said Letters Patent is hereby corrected as shown below:

In the Specification

In Columns 17-18 (TABLE 1-continued), Line 61, delete ">M5M79H9K_" and insert -- >MSM79H9K_ --.

In Column 27, Line 67, delete "CasaD." and insert -- Casϕ. --.

In Column 31, Lines 11-12, delete "34 or 35," and insert -- $_{34}$ or $_{35,}$ --.

In Column 34, Line 49, delete "IV/cm" and insert -- 1V/cm --.

In Column 42, Line 47, delete "Fer114)," and insert -- Fer114), --.

In Column 59, Line 6, delete "10$^1$" and insert -- 10$^5$ --.

In Column 65, Line 28, delete "vis-A-" and insert -- vis-à --.

In Columns 91-92 (TABLE 8-continued), Line 20, delete "k10" and insert -- k105 --.

In Columns 91-92 (TABLE 8-continued), Line 43, delete "k10" and insert -- k105 --.

In Columns 91-92 (TABLE 8-continued), Line 48, delete ">G8906" and insert -- >G89065 --.

In Columns 93-94 (TABLE 8-continued), Line 23, delete "_PR_" and insert -- _P_R_ --.

In Columns 97-98 (TABLE 8-continued), Line 29, delete "k1054550" and insert -- k105_4550 --.

In Columns 99-100 (TABLE 8-continued), Line 14, delete "829224" and insert -- 8292_24 --.

Signed and Sealed this
Twelfth Day of March, 2024

Katherine Kelly Vidal
*Director of the United States Patent and Trademark Office*

CERTIFICATE OF CORRECTION (continued)
U.S. Pat. No. 11,633,436 B2

In Columns 99-100 (TABLE 8-continued), Line 35, delete "k1055509" and insert -- k105_5509 --.

In Columns 101-102 (TABLE 8-continued), Line 46, delete "36088_" and insert -- 36088_19 --.

In Columns 101-102 (TABLE 8-continued), Line 75, delete "167652" and insert -- 1676_52 --.

In Column 114, Line 2, delete "141B)." and insert -- 14B). --.

In Columns 113-114 (TABLE 9), Line 5, delete "EC0P170" and insert -- ECOP170 --.

In Columns 113-114 (TABLE 9), Line 11, delete "MSM9VZOKR" and insert -- MSM9VZOK_R --.

In Columns 117-118 (TABLE 9-continued), Line 40, delete "CSM79H0Z" and insert -- CSM79HOZ --.

In Columns 151-152 (TABLE 9-continued), Line 17, delete "MSM5LLHGP" and insert -- MSM5LLHG_P --.

In Columns 157-158 (TABLE 9-continued), Line 31, delete "k105809042" and insert -- k105_8090_42 --.

In Columns 157-158 (TABLE 9-continued), Line 40, delete "3.HE-10" and insert -- 3.11E-10 --.

In Columns 159-160 (TABLE 9-continued), Line 20, delete "9.HE-10" and insert -- 9.11E-10 --.

In Columns 163, Line 46, delete "F." and insert -- E. --.

In Columns 165-166 (TABLE 10), Line 4, delete "Homololgs" and insert -- Homologs --.

In Columns 165-166 (TABLE 10), Line 7, delete "Homololgs" and insert -- Homologs --.

In Columns 165-166 (TABLE 11), Line 5, delete "Homololgs" and insert -- Homologs --.

In Columns 165-166 (TABLE 11), Line 8, delete "Homololgs" and insert -- Homologs --.

In Columns 165-166 (TABLE 11), Line 11, delete "Homololgs" and insert -- Homologs --.

In Columns 165-166 (TABLE 11), Line 14, delete "Homololgs" and insert -- Homologs --.

In Columns 165-166 (TABLE 11), Line 17, delete "Homololgs" and insert -- Homologs --.

In Columns 165-166 (TABLE 11), Line 20, delete "Homololgs" and insert -- Homologs --.

In Column 177, Line 26, delete "I²" and insert -- $I^2$ --.

CERTIFICATE OF CORRECTION (continued)
U.S. Pat. No. 11,633,436 B2

In Column 177, Line 54, delete "(line" and insert -- (Ime --.

In Column 179, Line 1, delete "Norm," and insert -- Norin, --.

In Column 186, Line 5, delete "Oiate" and insert -- Oñate --.

In Column 186, Line 43, delete "Ofiate" and insert -- Oñate --.

In Column 188, Line 19, delete "7.4/o" and insert -- 7.4% --.

In Column 193, Line 52, delete "Minion" and insert -- Minlon --.

In Column 194, Line 37, delete "Ofiate" and insert -- Oñate --.

In Column 195, Line 41, delete "Oiate" and insert -- Oñate --.

In Column 196, Line 14, delete "I²" and insert -- $I^2$ --.

In Column 196, Line 29, delete "resealed" and insert -- rescaled --.

In Column 199, Line 55, delete "Oiate" and insert -- Oñate --.

In the Claims

In Column 201, Line 41, in Claim 5, delete "hereof" and insert -- thereof --.

In Column 202, Line 65, in Claim 19, delete "NO16 bin.9," and insert -- NO16_bin.9, --.